United States Patent 10,233,495 (METHODS AND COMPOSITIONS FOR SCREENING AND TREATING DEVELOPMENTAL DISORDERS) - sequence listing, part 202

SEQ ID NO: 1558 - DNA, 421549 bp, Homo sapiens
cggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcgggtaagtggattctgaaggcaccccttgaacttggtagtttccccaacaaagaaagtttacagcccgaaaagtgtccttgggaaagcgccgacatttccccctagccacacgttgtaagtcaactagaaagcaaaagccatttcagactgcagtttttggttgaaaatggaaaatgctgttttggttagtcattattcactgggtagtgttaattcaattccaactaagttctaattcagataataaaagttaagcaaatttgaaaatagagcattgcgagtatttacatgctctttggcatactacttagttctgtaaacacttagaggaaggacaacgtgcgatataatctttatacccacatgattagtctactttttaaaatatccaagctgggtgaagtgcagaagtctgatatactatgctaggaaatgagattactggaaaatgttcaactagtaacaaattagtgcaaagttattataaagttacactgaacttcattctagtcttctaaacaatttctcttgaagctagattttcctccttttatgtagtgtcctgttgctgtaacttggaaacaggatttctttaatcgtgagttagggtatgaggcgtcgagacttgggtgcaggttttagggtgtccgcatggtgtttggagtgtggagagtgactcacaagcagctggtaggaaagaaaacagccgaattttgttggatttgtccttcataaaacacccatctatttcctggcctcaaaagcaaaagggtagtactgcttctcctctatgcacacttataatttgtctttttgtaagttattttctccctccaggctgcttttatttgcacatttcagtggtataaaagaggaagttggtgttacaatgtttgattttctctaggcttatgtatatgtttatggaatattattgttttttagtatatgatgttgaacatatataagattacacttctgggctgggcgcggtggctcacgcctgtaatctcagcactttgggaggccaaggcaggcctcccaaaggcaggcggatcacctgaggtcaggagtttgagaccagcccggccaacatggtgaaaccctgtctgtactaaaaatacaaaaattagctgggcttggtggcaggtgcccgtaatcccagctactcgagaagctgaggctggagaatcgcttgaacctgggaggcagaggttgcagtgagccgaaatcgcaccattgcactccagcctaggggacagagtgagactgtgtctcaaaaataaataaataaataaaacttctggtaactctagtcagtcagtcagtagtaaccagttagctactgacttggcttacttctaaaaggttaggaaaatttgtttcatccaaaagcattttaaggagttaaataagttagtcattgggggaggttgtataaattctatcttatggacatctttagtagtaactatatagttaaaagcttttgtggttgctatacatatatgaaaagactttttaaaaaattctttgtggagggcagtttttttgttgttgttattttgaaatgtggttctctctgctgtcctaaacctatgttccaacagtttgaaactgattaatgggtatacgtttgaccttttaattaaaacattaatttgtgaatgatcaacattccctaataagcttttcacaggttgttaagagaaacaaaagttctgtgactcttagtgactactgagattgctgcttagaaaggagctggggagaaagtttgctgtatctgtttttcggtggagaaaatcagcagctaacatcttcagttgagtgtgtgggagtttggaatcttgtcatctcttccctcttccaaaggtcaggtcctttggaatcttgtcatctcttccctcaaggaccgtatcacacatgctataggacagaagttgcaaactcaaatgatattgagtggggatggtagcataagagaatgaaacaggccacatttaagaagaataatggcataggttcaaagataaagacaaatggcagctgacatttggcacagtgtgtgtgacagtttctggagggtgggaacaggggctccctgatgccataactgaaggggcaactgggctatggccaggcctctctctttgtctttgagaagtcagcaaactttttttttcttttattgtaaatattcatactaattcagatttattaccaaacacactgtagtccaacactgcaggctgaacaaccccatttgtggagtgtttttctgtttctttttttttttttttttttttgagacagggtcttgctctgtcatccaggctggagtacagtggtgagatcacacggctcactgcagcctcgacctcctgggcctgagtgatcctctcacctcagcctccccagtagctgagactataagtgtgcgccagtgtgtctggggttggggagtctcactgtgttgcccaggctggtcttgaactcctgggatcaagcaatcctcctgccttgtcctccaaaaatgctaggattacaggcatcagccaacacgctcagcctggggtggtttttttttttttttttttttttttttgagatggagtttcattcttgttgcccaggctggagtgcagtggtgtggtcttgactcactgcaacctccgcctcccaggatcaagctattctcctgcctcagcctcccaagtagctgggattacaggcgcctggctagttttttttgtatttttagtggagatggggtttcaccatgttggccaggctggtcctgaactcctgacctcgggtcgttcacctgcctcagcctcccaaagtgctgggattacaggtgtgagccacagcacctggccctggggtgttttttgaccagtgggttacctacgtaagaatctctgttacccaggcctccaggccacacagtcccactgtgctggacgtagcctccagtctggtggagcagcatgtttgtaaagtgaaatgtgtgggcgtggttgttctgtgctaggagctacatcaactacttcctggtggccactgactgtcctaaatgcaagctgagattttgcttcttcttgtggttaatgtgcaattccatacgcttttattttgtacatatattcattagttcttactggctcctatttagtagccttgctacagattcctcaaattgacatctttaccaaagttgactgactgatgactcccaagaagttttttttgccacccaacacttggcatccttccagagctacagcccttgcccgctctcagttgggattcctgccatctttgttttgaatcagtcttggttttcaaatgccacttttaccacattttaatttctaagttactgttactttaaaattattatcaagttagtttgttgtttggttaattctactatgtatagtgaatgaggcatatatgtatccatagtgtttttagcttgcaattttcaaataactagacatatatgaattgtagttcaaaatgaatcattcacagacctttggctaaaacagatacgtatatatctcccctatttgtgtttttggctcactgcaacctccgcctcttgggttcaagcgattctcctgccgcagcctcccgagtagctgggattacaggtgcccaccaccatgcctggccaatttttttcatatttttattagagacggggtttcactatgttggccaggctggtctcaaactcctgacctcaggtgatccacctgcctcggcctcccaaagtgctgggattacaggtgtgagccaccgtgcctggtctaactgtgatactttatagttatcacagagttcattttcctactggaaagtggacagtggggataactggtctcagatgactcttttgcctggaatatgtgggatggaatgacgggtgcttgagagctattgctctgaaagtgttgacagacatgctatgtctacacacatgtagactgacagacactctgtctacatgcatgtagcacccctggcagacacattctgtgtacacatgtgtggtgtcattgtcagacactatttccatgcatgtgtaggaccactgacaggcatcctatgtctacatgtgtaggggatgaaacggttagatgaagaaggctattttgtaaaccattctctagactcagttgcattgctctgtagccatactttgcccaggtcatggaggaagcagagtagatctgttcaactaatacatggactgccaaaggtttatgcggtcttttcagcaagggtaatagcaatccttcataatctacactaccccctctgctttcctcaccttgcgtcctctccacattccaactgtgccctgttccactcccctgagactggtctccatatggccccagtttgttgctaaatctaaagttctcttctctgtccttctctgttcttatttcacctctcagcagcattccacaatgtggaccatggcctcttcataaagctctttcctcacttgcttctgtgtctccacgaaactcggattttcctcttaggtcactagttgttccttctcagactcctttgctacctgacacctaaatgcaggggcaccccaggaattgatcttggaccccattctctgttctgggtgtgcccctccctagcagatctcatcggggcccatgattttaaatagtgtctacatgccagtgatgcttaaacccccaatctttagttctgatctggcctgaaatttctgtctcagatgcctactgcctgctttttcttagttttctccatcaccgcttgccacaaccaccatccactcagttgttcaagctgtaagtttagagtttatccttaattctttcctctccctctctttatcgccccatccaattcattagaacccatcagcgttacttccaaagcatgtcttacattggcctgcttcattttgtctccactgatgcagccccagtccaggcagccaccgtctcttgtctggacactgcatttgtgtcctgactggtctccctatgtccattcttgccctacaaccagtttttcacatagcagtcagagggatcttttatttattttgaaatggagtctctccttgtttctcaggctggagtgcaatggcgtgatctcggctcactgcaacctccacctcccgagttcaagagattctcgtgcctcagtctcccgagtagctgggactaccagtgcatgacaccatgcccggctgattttttgtatttttagtagagatgcggtttcaccatgttggccaggctggtcttgaactcctgagctcaagtgatcctcccacctcagcctcccagagtgctggattacaggcgtgagccatcacacctggccagagggattttttgaaagtgtgaaggggtgggttgcccctccacacctgtgggtgtttcttgttaggtgggacgagagacttggaaaagaaaaagaaacagagacaaagtatagagagagaaataaggggacccagggaaccagcgttcagcatatggaggatcccgccagcctcagagttcccttagtatttattgatcattcgtgggtgtttctccgagagggggatgtgtcagggtcacaagacaatagtggggagagggtcagcagacaaacacgtgaacaagggtctttgcatcatagacaaggtaaaggattaagtgctgtgcttttagatatgcatacacataaatatctcaatgctttacaaagcagtattgctgcccgcatgtcccacctccagccctaaggcagtttttccctatctcagtagatggaacgtacaatcgggttttataccgagacattccattgcccagggacgggcaggagacagatgccttcctcttgtctcaactgcaagaggcatgccttcctcttctactaatcctcctcagcacagaccctttacgggtgtcgggctgggggacggtcaggtctttcccttcccacgaggccatatttcagactatcacatggggagaaaccttggacaatacctggctttcctaggcagaggtccctgtggccttccgcagtgtttgtgtccctgggtacttgagattagggagtgatgatgactcttaaggagcatgctgccttcaagcatctgtttaacaaagcacatcttgcaccgcccttaatccatttaaccctgagtttgacacagcacatgtttcagagagcacggggttgggggtaaggtcatagattaacagaatctcaaggcagaagaatttgtcttagtacagaataaaatggagtctcctatgtctacttctttctatacagacacagtaacaatctgatctctcttgcttttccccacaaaagtgtgaatcagattctgttacttccttactggtggtctccattggcttcctctgtgcttaaagtagaactcagactcctcttgctggttcacaaagccttcatgatttggcctctgcctgccttttctgcttcttggatagaaactcctggaatgcttttctctctgatctttgcacacctggccccttctcgtcgttcatacttagcatctaggtcccttcctcagagaggcccaccatcaccccatctgaagcagccaccctgtcactcataaaccctcctgatggctatttatttctctgatatttttctccctacttcctcctggagatgtgagcttttcatcataaagcaaggacctagtctagtctatgctagtccatagggcagtgcttggcacatagtagggattcaacaaaactatactgatacaaaatggatagtttacaaaaggcttccacatacattatctttaaggctcaacagcaccataaattacctagggatcattctctccgtgttactgatgaggtaactgacgttttagttgaatggcttacctaaagttacataagtaacatggctagcagtgagaggaagtggaacctgtgcagagggagaaacaaagtttagttcaaaacaaaacaaaacaaaactgtatcataatgtctccactgaaacatttatgttaagaggtcagggggttgaaaatagcagaccagcagaccaacattcagcagacagagaaggatgctcagtctgctcacagcatgtgccctgtgcactggggcttctcctagacccttgcagggatccacaaggtcaaaactgttttcataataatggaacaccattggccttttccactctgttgatacctgcactgacagtgcaaaagtgatgaatcaagacagcggtgccaagctgtactactagttcctgatttctttgccatgcacatggagagaatgtccttgctaataaagcagtgaaaatgatgacttttactaaatcttgactgttaagcacacatctttttcagactgtgtgtgctgctccttctcctgcaggcaaagcccagtggctgcctggaggaggagcatctgctgccttcatggacgcagcacgtcccaaaggaatcaccgacaggccgcctctggatgttgaggcctgtgtccacggcagacgtgtttttgaaaatgaacttagtgagctgtcacttcaaggaatacagctgacagtatttgctgccagtcatgaaatttgaaccttcaagtgaaaattggttttggaaaacttgtatctgccgctgtgagcctggcagcttcccaagacttaaagatgtttctggtgagatccatagtgatattaatgaatggaattaatgttgtagaatgaaatgtgcccacatttggaacagctgcataattcagtgaacaaatatttccagatgaccaatccatgatattataaaatcatccataggtaaaagatccgttcaatgttagaccagtggattttaatgtaatagggtacaaaaagttcaccagaggataggtgtttttttttctttttttttaagacggaatcttgctctgttgcccaggttggagtgcagtggcgcgatctcggctcactgcaacctccgcctcccaggttcaagcaattctcctgcctcagcctcctgagtagttgggattacatgtgcctgctaccacgcctggctaattttcatatttttagtagagatggggttttgccatattggccaggctggtctcgaactcctgacttcaggtgatccacctgccttggcctcctaaagtgctgggattacaggggtcagccaccacaccccgcttgatgttctgttgtgtgcgtgtgtgtatattttttgttgttatttgtttgtttcacagttcactgcatccttgacctgggctcaagtgatcctcctgcctcagcctcctgagtcgctgggactacaggtgtgagtcaccatgcctagattttttttttggattttttgtagggatggggtctcactatgttgcctatagtgagagtttaaatattttattcaaatagattgcaacagatctttaagaaactaccacttactcaattttgttgtaatatcaaataataatattctcaattatttggatattctgatactcctgccattatgtatctttgtgaggccagatttttctcacatacttcaaccaaaacagtgtatttcaacccattgaatgtggcaccaaaaatgagaatccaaggtggggtgcggtggctcacacctgtaatcccagcactttgggagactgaggcgggcagatcatgaggtcaggagatcaagaccatcctggctaacacgatgaaaccccatctctactaaaaaataccaaaaattagccgggcgaggtgacgggcgcctgtagtcccagctacttgggaggctgaggcaggagaatggcgtgaacccgggaggcagagcttgcagtgagctgagattgcgccactgcactccagcctgggtgacagagtgagactctgtctcaaaacaaaacaaaacaaaacaaaacaaacaacaacaacaacaaaaaaaatgagaatccagttgtcttctatgaagctggatattaaagagatttgcaaaaatctaaaaaaagccacctgagacaagtgacaagataactgacaatttttgaaaatatagttatttgtagaaatgttatttatttgaatatataataagtttgatttttaagtgaattcataaatatatcaattatgtttttctgttttaaccttcaatacggaaaatgttgataaatgaaactcataaaaaagctctttgagggtcttcaggaacctttaagaccgtaaaggggccctgctgccagatgtttgagagttattagtgtagttagaagaaagtgggcctcatccttaggaagaagggcttgaggatatcaggtggctggtcagaaatgtcaggcagggccttgaagtgacattagataagaaacataaaggccctaatctgttgccctctttccattcgctctgcctaaagaactgttgaggtctctggacttggagctgggaggatgtttgtgaagagcctgtgtgattgtgagggcagtggccttacatgtggccacctagccctccatcaggtccttctattgctccagatttctagtgtgtgtccggagggagatgcaccaccgcccacccagtagctcttgtgctgggagtggaggaacacccagtctgtctggaggaatgtccactctgtctggcaaggaggaggtggccagaggttcagccaaggtggacagctcacgggaagtgtcctgtctctccagggcgctgctgcctagacagactgacagacacggtagcaccaaattacaatacgcaagtataggtatcaatcatagtaattacaggtgagaatgacattattacggggagcatcttgatttaatattaaataagtaaatcatttgcattgaactgcatttatgaaagaaatcatccacattgaccagcattaaactcccagcagccagtgacttcatgtagttggtgatggggagctgtcccaggattccagctggggagttgttgtgcataaatttgtgttttgaaataccttattggctatggatggagtggggtgattggagaggggcgagactggaggtgggggcaccaagtggagaggagttgtgctaatccaggtgagaagccctgggggctgggcgtggtggctcacatttgtaattccagcacttcgggaggctgagctgggaggatctaaaaagttttttgttttttttttcttaaatctaggtagatactttgtggttcccgagactcacatgagacactcacatcagcgcttgtgtgattgtaagggcagtggccttacatgtggccacacagccaccgtcagggcctcctatttctccagaattctgtctcacctctccaatccctctactccatccacagacaataagatctttctaaacacaaatttatacacaacaattccctagctgggctcctgggcagctccccatcaccaactacatgctgagcccaggaatttgagaccaacctaagcaacaaagtgaggccctgtctctacaaaaagtaaaaaataagccggacatggtggtgcgcacctgtggtcccagcaaattaggaggctgaggtgggaggatagcttgagcctgggaggttgaggctgcagtagtaagctatgattgtgctggtgcactccagcctgagtaatagagtgacaccctgcttcaataaaaacagcaagaaaagaaaccttgggagccacaaaagaggcggctgcagtaggaatggacgatagagcatggatcctactgatttgaagaaggtagaaatagaatgtgaagtggatgggttccagtgggtggagtttgtgggtgtagtgtggactggctggctggtacagttccgctctttttatttgctcttgaaatggatatacttttcattagtgagtctcatgtgagtttcaggagtcacaaagagaccatctacccagattaaaaaaaaaaaaaaacttaaaacatgctggccaggcacggtggctcacgcctgtaatcccagcactttgggaggtcgaggcgggtgggtcacctgaggtcaggagttcgagaccagcctgcccaacatggcgaaaccccgtctctactaaaaataacgaaaaatgagccgggcatggtggcgggtgcctgtaatctcagctacttgggaggctgaggcaggagaatcgcttgaactcaggaggtggaggttgcagtgagccaagatcttgccactgcacttcagcctgggtgacagagtgaaactctgtctcattgttccattctgaagagctgtggaagactcttgagatggataagaacatgtcctcattatcaccctgtggagttctagagctagagttttaacaagatagcatgtggattacacataggaggtgtcctccagtttctgactctatcctcctcttattcaaatgactttaaaaaggaattttgaaggctaaggtgggaggatcacttgaggaaaggagttcaagaccagcctggtcaacatggtgaaacacccatctctaccaaaaatttaaaaattaggcgtggtcgtggatgcctgttatcccagctacttgggaggctgaggtatgagaatcgcttgaacccgggaggtggaggtttcagtgagccaagatcatgccactgcattccagcctgggtgacagaacgagactttgtctcaaaataaatcaataactcaataaatcaataaatacaaaaataaggaggtattttggtcatctacaatacttgtttcaggagagctgaagtttgatacctttttctaagtctaaatatatggaaaatggccaggcacagtggctcacgcctgtaatcctagcactttgggaggctaaggagggcagatcacttgaggtcaggagtttgagaccagcctggccaacatggtgaaaccctgttttctactaaaaatccaaaaatcagccgggcatggtggcagatgcctgtaatcccagctactcgggaggctgaggcaggagaatcacttgaacccaggaggcagaggttgcagtgagccgagatcgtgccactgcactccagcctgggcgacagagcgagactccgtctcaaaaaataataataaataaatacataaatatatggaaaatgccattccagtaaatatttggcattgcaaatcaatgctttaactgtgttctaggctgggcacagtggctgatgcctgtcatcccagcactttgggaggctgaggcaggtggatcatttgagctcaggagtttgagaccagactgggcaatgtggtgaaactctgtctctacaaaaaatacaaaaaattagccgggcatggtggcatgtgcctgtggtcccagctactcggatggctgagtcaaggggatggtttgagtcagggaggtcaaggctgcagtgagctatgatggtgtcactgccctccagactgggtgacagagctagaccctgtctcaaaaaaacccctgaaacccttaaacttgtcacatattggtgggtgtgactgcagagaattgtcatgccttcagaggccgaacaggaaacagctgaagaggagacagtcgccgagaacaagtttgaattttacccagctgtcggtatatttttcaggtgcgtttattgttcttgactagtactttttgtattttaaaatgttgatgtaatttcaaactgacggaaaacctgtaagaatagtatcatgagcttccctatagcctttgcccaggtttgcagattgtttacatctcgccttgtttactgtcaccctccatttacatattcagactgagctggagatgctgtcccccttctactcctaaacaccgtgtctgtctccttagaggaggccattttcttacgtaagcacagtgcagttgtgagagtcaggacctgtatcatggatatgtgctcccggccctctgtagttcagaaggtcaggtgttgctgcctgcccagcaatgccctcattatgccccgcccgtcacccaggatcacacgttgcatttggtggtcgtgtctgtgtagcctaccttaatctaaagaagtctctcagtctgttttagactttcttgaccttgatttttttaactgtgaatttaccatctcaaccatctttcagcacacagtttagtggcagcaagcacacccacatgcttgtgcagccaccaccagcatccaccaccagcagccatctccagcagctttccatcttcccagactgaaactgtctccattaaacaccaactccccattccccttccccagcccttggtaaccgctcttctgctttctgtctctgaatgttttggccttgcatgtagtagaatgtcctgaatttgagctgcctagtctttcctcatattcacactgagatggggcattttgggtaatgatgcacctttgtcagtgaatcccatcaggagcacacgacggtgctttgtcccagtactgtcatgctcatttgatccattaccttcaagccgtttcttgctgagtggtcgcctcctgactgatgctgcccttttgccatacctgtttgggagcacgtcctgactttccagcacaaccagagggcccaagctcactctgtgccctccctgccccagtcctggaattagccttttctccaaggagcctggttcctgttagtggcgaatggcattgagaagccacgaacgtgtgcatttagagctgggctgtgtgctttgcccttggtgtggcatgcgtctcccgttggttggccctctgagcaggagagagaggatggcgctctgtcttgtttacctctgtttctctgtgtatgctggaaccatggatgtgtagagagagctccagtccagctcctcaccatgatatgttcagcccttcccactttgcctgctaccactccctacccagccatgggaaaccagctccattgtcctcatttaatcatgggctcaaagctggaatgcacagaagggagcctcggaatggctaacgctggccacttgggaaagcaaatgctgcaagaggttgacttccttgttttctgaggtaaacgttacatatggtgaaatgcacagaccccagctatctgaacaattggctcatgctgtctagaaatgtcagcattagtcagtgttttgtgggaaatcactgttgttttacatagatggcactgcacgtagggtgcatggggtgaaggggacggaagacgtggtcatggccctgtaggaatttacatcttataagagaaaaacaacatccttacccacagctgagtgaaaagcacagtgcagtcatgatctgcccttgagtaacaaggtagcgatttcaggaattctgcagctggacattgagatggtgtctgttctgcaccagagacttggctgagctcctagctggatgggctgtggagtccatggtggctggacgaagatctgtgtgctcaggtggagtggttgcgggagcagggcggaggatggacaatgaattcacaagtgactgatgtatagaatttagtcattcagctactatcatcgagccccttctctgtgctgggcactgggctaagtgctgcggataccatggggagtaattcctgcgttgaaggtgttttccagtctatcagggcagatggatgacagtgcaggaggcagggtgtgaggtggtggtggctggatgggccggacggagaaaggccttctggaggtgggagctctaagccagtagctgaaacagaatggaagggagtggggtggaaggttcagctggaggaacggggacgtgcaggagctgagaggtgagtgagcagggtcttcagggaaacgccactgggggcctcctgcaaggggccttcccttgtgctgtgggagccgcctcatgcccacccggtgctctgtgcctgccattcccttcccacactgccactccccagcacttggctacgtgttcgttttgtctccccactaggatgttgtatagagaacagggactctgtgttcactgctgagcccgaggctgttcccggggtgactggcggtcaataggtgatcaataactgtttgttgagtcaaggaagggagcagagaccctgagaagagaagaactgagagatctgtgagccggggggctggacaggacagatcctgaccggcttataaggccacaggaatttggattttatcttaagcacaagtaagaaagcttttaaagcagggtggtgacatgttcagaatggcattttattttattttatttttgaaatggagtctcactctgtcacccaggctggagtgcagtggtgtgatctcggctcactgcaatctccgcctcccgggttcaagcaattctcctgcctcagcctcctgagtagctatgattacaggcacctgccaccacacccggctaatttatatatatatgtatatatatatgtatatatatatatatatatatatatttagtagagatggggtttcaccatattggccaggctggtctcaaactcctgacctcgtgatccgtcagcctcggcctcccaaagtgctgggattataggcatgagccacgcacccagccctagaatggcattttattttatttttatttttagtttttttgaggcagggtctcactgtgtcactgaggctggagtgcagtggcacaatcaccgcttactgtagcctcgacctccctggtctcaggtgattctcctgcctcagccttctgagtagctgggactacaggcatgtgccaccatgcctggctgatttttgtatttttttgtagaaacagggttttaccatgttgcccaggctggtcttgaactcctgggctggagtgattcaccacctcagcctcccaaagtgctaggattacagacatgagccaccgcacccagcccaggatggcattttacaaagatccctgtggctgcagactggggtgtgtgagaatgtgtatatgtgtctgagtgtgtacgtgtgtttgtgtgtgactgtgtgaatatgtatgtgtgagagactgtatacatgtaagtatgtatgtgaatatgtgtgtgtgtgagtctgtgtgtatgtgtgattgtgtacatgtgcttatgtgtatgcatgtgtgtttatgtctgtatgtatgtgtgtacatgtttatacgtatgtatttatgtgtcagtgcatgtgtatttgtgagtatatgtgtgtgttagggaggagcatggtgtggggtggggagtctcttgagggtaggaggagatgagggtctggtggcggcttgggctggtagtgacaggcccggcagccccaagagcccctggaagcagaattgcgacccttggtgactgcttgggtgcaggaggatgcagggtgacacgcagcctcctaactggatgtaggagagaaaaacaagatacaccaggcatttggaaagccaaagaacacgtgtttgcttgtgaaaacttaaggaatgttttggtgggatatgttgaaattgttgcctaaaacgatcgctgatcttgtgcccctcagtgtgtggccttcgtttacccctgcttcccctcactcccctgcttgggggctgggtggtcatgacagcctccccagtacacagtgagcatcttttagtttgatgttttcttggagagctttttattttatccttaaaagtagatcagacaaggccgggagcagtggctcatgcgtgtaatcccagcactttgggaggctgaggcggacggatcacttgaagtcaggagttcgagaccagcctggccaacatggcgaaaccccgtctctactaaaaatacaggaattatctgggtgtggtgacgcacacctgtaatcccagctactaaggaggctgaggcaggagaatcgcttgaacctgggaggcagaggttgcagtgagctgagactgcgccactgcaccccatcctggcaacagagcaagactcttgtctcaaaacaaaaaacaaaaacaaagtagatcggacaagcagtttaaagatatatcaaaacaaaagtactgtgaaaaagttaaatcagatttttcctgcattttctgtaagtccttgctgaggtccagatttagttttcagctaggtgtgaccgtcgcctgccttgctgccgatgtcctgaagatgcttcatgttggcacatgtggcttcatcgggtgggctaccatcctgcatcaatagtgggccgtttccatggtttctggtctgttgctggtctggcttggcaggtggcagagcctgggtcagacccgcagtttggcctcagggctcaggctccagagaaccactgtgcagccttttacttcgtacacacagctcttttcaccaagatgtgtttttactgggtcagcaggcatgaatgttttccctgaagagtttttttttttaatttttatttttgagacagggccttgctctgcaacaggctggagtgcagaggtgtgatcatagctgaggaggctgaggcgggtggatcacgaggtcaggagttcgagaacagcctggccaacatagtgaaaccccgtctctactaaaaatacaaaaattagccaggtgtggtggcggccgcctgtagtcccagctacttgggaggctgaggctggagaatcacttgaacccgggaggcagaggttggagaattgcttgaatccaggaagcagaggttgtggtgagccgagactgcgccactgcatttcagcctggataacacagcgagactaagtctccaaaaaaaaaaaaaaaaagataataaataaaaaataagggagataaagttctgttttctttttttgttttgaaatcaagatatttgttttagtcaggttcttttggttgcaaagaagagtctcacttaaatgtccctaagcaactatgttgcctaaggatgcccagtgcatcttaattgctggatgagttgccacaaagtgaacactctcacaaccagatccagaaacagaacagccccgccttgaagatcctctgtgcccccagtcgtgcccacccctccccaggaagctgtgctcctgatgtccagggttgtgtgaccttacttttgcttttggtttctctcgctcagcattgtctgtgagattcatccatgctgctctagtagccatgctcattcacccccttggaccgcagttaactcacctgctgatggacatttgggtggtttccagcatttcggctactaaaattgtgctgcagggaacattcacatgtcttttctttttttttttttggagacggagtctcgctctgtcgcccaggctggagtgcagtggtgtgatctgggctcactacaagctctgcctcccgagttcacgtcattctcctgcctcagcctcccgagtagctggaactacaggcgcctgccaccacgcctggctaattttttgtatttttagtagagatggggttttaccgtgttagcaaggatggtctcaatctcctgaccttgtgatctgcccgcctcggcctcccaaagtgctgggaccacagctcgcatgtctttttgggaacatgtatctaatatgtctctggtgttgattcctaggggtggaattgctgggagatagagaatacaaatgttcagctctaggagataccgccacacccttcttattttattttattttttcatattaaaacaacatttattttaggtttagaggtacatgtgcaggtttgttatataggtgaactcacgtcacagtggtttgtgtacagattattttgtcagccaggtattaagcctagtacccaacagctttttttttttttccggatgtgcaggtttgttatataggtgaactcatgtcacagaggtttgtgtacagattgttttgtcagccaggtatcaagcctagtacccaatagctttttttttcagatcctctccctcctcccaccgtctaccctcaagtaggccccagtgtgtgttgttcccttctttgtgtttgcatgttctcttcatttagctcccacttataagtgagaacatgcggtgtttggttttctgttcccgtgttagtttgctaaggataatggcctccatgttcccacaaaggacatgatcttatttttttgtgtggctgcatagtattccatagcctatatgcaccaccttttcttttctatatgttgatctctggcatgtaccacattttcttatctgatctgtcattgatggacatttaggttgattccatgtctttgctattgtgagtagtgctgcagtgaacataagcatgcgtgtctttatggtagaaggatttctagctttgtgtgagagtcccagttcctccacatgcttgccaatacctggaacgcatgttatcttgaaagttttgtagaaaaacacctacagtccttacccttgagacttgtacagataatactaggaagtgtctcttacatgggagagtctttttgtaactgttggatgactgcgccaatgccatcaatgactttgtgaggtttggtggaataaggagcttggtagaagctggattgctgcggaataattgttaagaaggcaaagggaaggggaggtggtggtcacacaccatggggggtgtaggaggagcaaggtgggctggtgactgaaggaggccacagtaaaacaatgttttctttgagaaggagccagtgcaggggagagtcaaggcaggggagaatgtggtgaagcaagcggcactgctgaggaggggttagagccccagggctgggaggcggagggaggcgtgcactgctgtggaggggttagagccccagggctgggaggcggagggaggcgtgcactgctgtggaggggttagagccccagggctgggaggcggagggaggcatgggtgtgggagctgtctcgctctgtactttgtatctctttataatttgcaaacattttaaaaggtggattaatttccctaatcctgacaaaggccctagcaggcttattttgttacagttgagtaaactgaggctatttggagagcacagccaaccttaccaaattctttgggtgttaagcggcgagccaggagctgcatctagcgctgggacagctttggtgcccggtttctacactgctcttgcttagttttgagtgcagcctttctggcagtttctcattggtttaaagtccctccttatgtggagtcagacaactttgatggacttgaagaattgaagaggcaacatagtttttatctaagagaatgggatttggagtcccactgacctttctccaagctggttccacggctctctacctgtctgctcctggtctgagtctgagtgttttcatcaatcaagtgggtctaagactcctcctgcatagcgcagctgtagggattaagcaggataatattgagaaattccctgggactgcttgactgtagtttaagagcccaatgtttggtgcctgtctcatgccgtggtcagcttctgtgcagcaaatagagatagcgcggtaactctgtgtgtgctgttatggagaggtttcccagatgttactaagtaaaaacaatgcaaaacaaggcacagaacagattttatggtatgaacctatttgtgtttttaaaaaggtatatgtacacataaataaaataattatataaaaaatttatggaaggtatacacttatacacaggtatgggaggtaggggtaggtagaattataagaatgtatattttcctggctgggtgcggtggctcacgcctgtaatcccagctcttagggaggccgaggcaggcggatcatgaggtcaggagatcgagatcatcctggctaatacggtgaaacccctcctctactaaaaatacaaaaaaaaaattagcccagtgaggtggcaggcacctgtagtcccagctacttgggaggctgaggcaggagaatggcgtgaacccgggaggcggagcttgcagtgagccaagaccgcgccactgcactccagcgtgggcgacagagcgagactccgtctcaaaaaaaaaaaaaaaaaaaaaaaaaaaaagaatgtatattttcctgtacttaatttaaaaaacttctgcatgattattttagtgttagtttaaacagcaacaacaaaatattacccttatgatatgttctctattagcttattagctgtacctctttttttttttgagacagagtctcactccatcacccaggctggagtccaatggcatgatctcggctcactgcaacctctgtctcccaggctcaagcgattctcatgcctcagcctctcgagtagctgggattacagatgcatgccaccacatctggctaattttagtatttttagtacagacagggtttcatcacgttggccaggctggtcttgaactcctgacctcaagtgatccacctgcctcagcctctcaaagtactgggattacaggtgtgagccaccatgcccaacctatacctttttgttttattttatttttttttttggtggtggttctaagattttcaatattacatctttaagttatcacagtgtaccttcaaatgatattatgccacttcacatgtaatataagaaccttatagaagaagggtgtactgctctcccccgtccttttgctatcaatgtcatacattttatttccacacattttaaaccccacagtacattgttattacttaaaaaaggtctggccgggcgcggtggctcacgcctgtaatcccagcactttgggaggccgaggcaggcagatcacgaggtcaggagttcaagaccagcctggtcaacatggtgaaccctgtctctactaaaaatacaaaaaaaattagccgggcatggtggcgggcgcctataatcccagctacttggaaggccaaggcaggagaattgcttgaacccgggaggcggaggttgcagcgagccgagatcgcgccactgccctccagcctgggtgacagagtgagactctgtatcaaaaaataaataaaataaataaataaataaataaataaataaaagtccattatcttagaaataaattttaaaataagaatatctcttatattaacccacatatttctatttattttttctttttttttattctgagacagagtctcactctgttgcttcgtctggagtgcagtggtgtgatcttggctcactgcaacatctgcctcccgggttcaagcaattttcgtgcctcagcctcccaagaagatgggactacaggcatgcgctactatgcccagctaatttttttgtgtttttagtagagatgggatcttgccatgttgaccaggctggtctcgaactcctggcctcaagcagtctgcctgcctcagcctcccaaagtgttaggattacaggaatgagccactgcacccagcccacatatttctgtttctaggcttcattccttttatagctctgagcttgaatctggtatattttccttcagtctgaagaactttaactttgcttatagtactggtattttggtcacatgttttctcagcttttgtttgtctgaggttgtccttatttcacctttatgctcctagcactttaaggatgttctgttgtctcaggcttgtcttgttcctgaagtctgctgttggtcttacttttgttctctagtatgtaatattctttttctcctccagctactttaaagatgtttttgtcattggaatttagcagtttgattacaatgtaccttggtgtagttttctttgtgattagcctgcttatggtttgttgacattcttggatctgtaggattatacttttcaccaaaattttggaaaatgtactgccattatttttccagttttcctatctctccccttgttcctcctcaatcttccagagctctatttacatttattttagatgctagatattgtcccactgaggatccccattccctccatctttttttcctctgtgattcagttgaattgtttctgttgcaatgtcttcgcgttctctcatctattcttctatagtatctaacatgctctttattttattgttacagagacaggaggatctcactatgttgcccaggctggtcttgaactcctgggctgaagtgacctcccatggtgtcaggattacaggtgtgagctgcaatgcccagccctaccatgctcttaagccaactcatccgatgtatttcaaaatttcagatgctattttttttctttaaaagttccatttggatttctttcttcgtattcatgctctcttttaaatccttgaacaaatttgtaatattgttttaaaaatcttatctgttatttcctcgtcactctcatttttgggtctagatggactgactttcttgtggttgtggatcaggctttcctgctttttcttacctctagtaatttctgattggatgctggacatagggagtgttacgttgttgagcatctgcgttttgttttctgcatttaaacagtgttgagttttgttctggcaggaagttagtttacttgtagatcagctgccttcttatagggcttgtttgctgtcttttaaaaacaggtctaggccgggcgtggtggctcacgcttgtaatcccagcactttgggaggctgaggcaggagaatcgcttgaacccgggaggtggaggttgctgtgagccgaggttgtgccattgtactccagcctgggcaacagagcgagactctgtctcaaaaaaatgaatgaatgaatgaatgaataaataaataaaagcaggtctaggtcaggattggaaaactatggccccttgcttgtttttataaataaagtcttctggaacacagtcccattgtttgtggatggtctatgttgatttcatgtgacagtggtaaagttgagaagttgaggcaaaatctatatgtcccacaaagcctaaagtatttattatctgcccctttacagcaggaaatttggtgacccctagtctagagaagcctttacttttggtctagtttagccctgtgcctaacgttgtggcctttctgagtctccgtgagggtcgtgggtgcttcatgaggtcccttaattcttcctcgttggagcttgaatgtttctcaccctgctccgcttctcctgcccctgtggctgctctttgcctggcctcctggagtctcaccagcagcacgccctgccttgccttcaggcagggactcaaggagcccagctccgtttctgcctcctccgtgtggctgtctcctccttgttactctgccgctctcattctggctgctgtggccatcatgaactcagacctctctctcctcagctcagtgactgtcacggtctgcatgggcccctgtctccatgcagaaagctcctgtgtcacggggcacacctcatttgtcttcccgctcagggaccacgttcctgtatgactcgttgttcaatgcctgaagaagtgttttatgtattgtgttcagttttctagttgtgtatggtgggagggctaggctgttcctacttagtccatcttttcctggaagtggtagtccccccaagtatgatatagaaggggcaaatgaaagaaagtgccagatagatgaatgatgcgtgacgggatcaccttttattaagtaggttagagtagctgatggttgatttttttatttttattttttatctttttgagacagagtctcactctgtcacccaggctggagtgcaatggtgcagtctcggctcactgcaacctccgcctcctgggtttaagcgattctcctgcctcagcctccggaacatctgggactacgggtatccaccaccatgcctggctaatttttgtatttttagtagagatggggttttaccatgttggccaggctggtctcaaactcctgacctcaagtgatctgcctgcctcggcctcccaaagtgctgggattacaggcgtgagctaccatgctgggcctgatggttgattctttacagtgaataagttgttatgtattaatgagttgttctttcactgaacctaattatcccccccagtggagtttcactttccaacttacacacagcattaatatttaagattacattggtgtatcacattaatagtacagattaaagtttggaagagttcagctttcatgatccctagacaactaatttgcaaggctagatttagagtttctcctttctctgatagaaacatttgcatttcacttgggctttataacgccaggtaggtcagaggttgaaactgaaataattgttaaacacgtaagaggatttaaggataaaatcctcccctgttttggtgttacagatctaaattgggcactcagtcatgtagtgccagagtgcgggatttggctggctaccttaaaggtttagttaattatacagaaatcctctttcagtgttaatcattgttcatgtcctatagaaaatggtctaattgttcttttcatttagctattttgtttaagaaggtcctttctagtctgatttgatttctttcttttttgaaattaggaagtaaagaatacagaaaacatctatttacaattccatcagtatttataaaaacatctgtgtgcccccagcccagtcaagatatagaatatttcagtaccctaggacttctttatgtgttgcaccttgatcccagttactccttttcttaaagaggcaaatacttttcttccttttgttggcaataattatctcttcacttttcttttgagatcgggtctcattctgtctcccagactggagtgcggtggtgtgatcatagctcactgcagcctcgacctcctgggctcaattgatcctctcacctcagcttcccgggtaactgagactgcaggtgcacaccaccacaccaagctaatttttgcattttttgtagagacagggcttcaccgtgttgtccaggctcctctcaaactcctgagctcaagcaatctgcctgccttggcctcccaaagtgctgggattataggcatgagccactatgcccagcctcttcacttttcttaatggttttcctacctgtgcgtctctaaaagttgtacttgcgttttcgtgtgttgcttcttttctcagtatcgtattgataagaatcaggtggttgagaaaaacatttaggtatgctgtagggatagagtaactattttaaattcttttaaacaaaaaaatcaggtgcttgaatatatgttgtttacttctatgtaatatctcatttcatgtgtacatcacaatttacttatccattctactgctgaacaatgttgaaattagcattacatatttattttagagactgcgtctcactctgtcacccaggtgggagtgcagtggcaccatcacggctcactgcagccttgacctcccacggtcaggtgatcttcccacctcagcctcccaagtagccaggactacaggcaggtgccatcatgcctggctaatttttctttgtatttttttgtagagatggggttttgccatgtttcccaggctggtctcgaactcctgggacaaatgagcattcttatatattctggtacacctaagcaggcataggatataagataattatatattttcttcttttttttaaaaaaatgcctgttcaagtcttttgcccagttttctgttgagttgtgtttttcttactgattttaggagcttttatatattttgaatatgtattataaatacctcccagcctgggcaacatagtgaaaccccatctctcaaaaacaaacaaacaaaaaaagtagccgggcatggtggtgcacacctgcagtctcagctacttgggaggctgaggcaggaggatggcttgatcccagcagttccaggctgcagtgagtcgagatcgcaccagcacactccagcctgggtgacagagtgagaccctctctctaaaaaaccaaaaccaaaaacaaatctcaaaatctttccactcggaggcttgttttttcatgttccttatggggtcttttgacattctccattttaatatggtctgataatcagtctgttcctttaaaggttggtgctttttttgcatcttatttaggaactctctttctcccttgatggcatgaagttaatctgtattatctgttaaggctttatgctttttctttcctgtttaagttttgtataaactttgtgtatggtttaaggtggggatctagtttcccatgtggatatctagttgtcttagtagatttttgtgaaaagctcatccttcttcctcagttgcagtgctctgtcgtaggccaagtaggtctgtttgggacttgctgtttatcccattgatctgctggtgtcattggtcagccctagcaccactctgtctgctttaattactagggctttataaaaaatgtgtgaaggaagcacttgtttttcttgagaatgtcttggctattcttgttcttttgttcttcatataggtttaacaattagcttgacgagttcaaagaaagaaaatttggggggtatttgattgggattgcactgagcctatacatcaatttggacagatttgatatcttttcagaattgagacttctggtccacacacatggcatatctcttatttagataggtcttctttaatttccctgaattaagttatatgcttttccctgtagaggtgttgcccatcttttgttggaattcttttaagtacttgatattattttgatgctgtcctaagaggcaactttaaaaaatttaagtttttagcctgttatttggtaggtatataagagtaaaaattattttttatattgctttatatgcagcattcatgatatctccatgtcatcaggagccctggcagccatgcacacagcttcctgcccccttgatcctgaagagtgtgtaaggctgctggggatcggatgcagttatgtaaggggtgtggatgcagaggagccagccgtggtttcatgctggtcttgagtgtcattctaatcatgaggccaccttacacccctctactccaggacatcccacagatcagaaggctcatgggaacccagatggagaaccagctcctagcactggccttccccatttatcttaactggtgcatttccagggcagcagggctgcaagagtcagccctacagctgtctgcccacatgcctgggtcgggggaagttttgggcttcatgtcaattcttgagttcccgagagttcgtgtccaggttgggaataacttgtcccacaaatgcctggtagaacttgcccataaggtcatgtaatccgaaagtgttgtttgtaaaaaaatttttaaagttctgatttaagcttttaagatggttttttttttcttttttctttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtctcgatctcctgacctcatgatccacccgcctcagcctcccaaagtgctgggattacaggcgtgagccaccgcgcccggccggttttttttttctttttgagtcagttttggcaagttacattttaagaagactttgtctatttcatctaggtttcaaatttataggcataaagttgtttgtaacatcctcttgtgatctttttaaagtcaatgggactgtagtaatgtttcctttttattcctgacattgagatttgtgcgtccactcttttttgttgttgtttttttgagacaagatcttgctttgtcacccaggctggagtgcagtggtgcgatcatggctcactgcagctttgaactcctgagctcaagcggtcttccccgcttagcctcccaagtagctgggactacagatgtgtgccaccaagcccagcttatttaatttttttttttttttttgtagagacagggtcttcttatgtttcttaggctcatcttgaactccttggcctcgagtgatcctcctgccctggcctcccaaagtgctgggattacggatgtgagccaccatgcctggccccctagtttattttatatcttattatttccttttttctactttccttgggtttgttttattaccttttccgccattcttgagggggagattcttgagatgagtacttaccttattagttttcagccatttgtcttttctagtgtatgcacttagcatttagaaatgtaaatgcttaatggcattcaacaagtagtagtttttaaaaatatatttatgtatttcagagacgaggtctccctgtgttacccaggctggtcttgaatcctggctccttccgccttggcctcccaaagtgctgggattataggcatgagccaccatgcctggctggatatacagtatttttgttcagttcaaattattctctaaattttattttgacttgatcaatttattatttaaaagtgttgtaatttttaaacatagaagactttttctaggatttatttttgatttcttaattgcattttgatcagtagacgtctgtcagcagggcagtagcaggtgcaccgcacgtctgtagggggagccatccacaccgttgccatgtgcgaatggcgccccctcgtgttgtggatggtgtaggttgcaccgctgtgtgcacacgtgtgcatacatgcatgcacacgcttggaatttcagctgctctgtcccttataggcccgtgcgtggtcagtttttgtaaatgttccctgtgtacttgaacacgatgcgtgtctacagctgttggtgccaccttttatacgtgtccattaagtcaaatattttatttgtggtgtacaaatcatttacactttactgatttttttgactgtttctatcagtaacagagaggtgtattaacacttctcaccatcattgtaaatatgtctattctccttattagacatatttagatagaattctctgcccatttgtgcttcatttatattttgaggccatattgttgtaaaactgttgtatcttcctggtaaattggagtctatattgttgtaaagtgactctttatccctaataaaactttttgccttacagtctgttttgtctcaggatagttacaccagttttctcttggttagtgtcagtcttgtttatttgtccttttatataagtcaacacttctgtagccttgtatttttcatatgtctcctataaacagcttgtagttggattaaaacagatcagtctgatgatttttgtctttcagttggagcacttagtctacttacagccattggggcctaaatctgccatctcttttgtgctttctatttgtccttcctgtaatgtttttttaaatgcctttttatagattgaaaatatttaatttcttcccttttactatttttgaagcagtgcactgtttttctcttgtaatggtttcttagaaattacagtaggaatactgaaaaaagtacaacgtccgtcatgacctttattcttttcttagacaacccaagacttaggaaattatttaatccgtttgtttcttgtatgtgagtattgctgtgtacagtattttatttttaacatcccaagttaccatccttgttttcggcagtcattgttctttcaggctgatgcacatgcttttgactcttcgctctcctttcctttagcgtctcagaactttcctatggggccacctactttgactgaaagacttcagaattcttttctcatgacggtctactgatgccacattcacttcgttagtctgaaaatatcttttttgtttgtgtgtttttgtttttttgagacagggtctcgctctgttatccaggctagagtaaagtggcatgaccttggctcactgcaacctccacctcctgggttcaagccatcctcccaactcagactgttgtgtagctgggacagcaggtgtgtaccaccacacccagctaatttttgtattttttgtagagacggggttttgccctgtggcccaggcttgtctcgaactcatgggctcaggcgatccacataccttggcctcccaaaatgctgggattacaggcgtgagctcccatgcctggcctctgaaaatgtctttattcagtcataattctttttttttttttttgagatgaagcttcgctctttttgcccaggctggagtgcagtggcacgatctcagctcgctgcaacctctgcctcccaggttcaaatgattctccagcctcatcctcccaagtagctgaaattacaggcatgcaccaccatgtctggctaattttgtatttttagtagagatgggtttcaccgtgttggtcaggctaatcttgaactcctgacctcaggcaatccatctgaactggcctcccaaagtgctgtgattataggcatgagccaccacacccggcctcagttgtcattcttgaaaggtatttttcctagggatggaattctagagtgatgttttcttttagactttgaggacagctgggacctacaggtgcatgccaccacacctggcaagttttacattttttttatagagctagggtcttcctatgtggcccaggcttgtcttgaactgctgggctcaagcagtccccctgcctcggcctcccaaaatgctggcattagaggcgtgagccattgcgcctgactctccagcttatttacagtcctttccacggaagtcactgaagaattggataagtgtacagtctatacttttcatcaagcaatagataaagaggtagcagcagggtgtcatggccagggtgtcaaactgtgtggaagctgcagtccagctctggagctgggcttcatgcccatctccagtgccattctcttcgaagggccttggacctgcagccttcctggagggagagggtgaatagccaagatgcagaatgggctttctttgtaatctggaagacctacgcttaatgaagcagtgtcagtttgaacacttcttaggcttatgcaaacatgtttaggttattttagctgattgaaggcaaaatatggcctgacgctgtgatgtgcggcgcagtcaaatgcgtcagaccctggctgtgttcacagagtgcagcatccagactgagggcggagatagcctctctgctcatgagctgtctctaaagaagcgccctctttaaaaagattgcacgttacattggaatttattcaaggtgcgtggctgagatagtgaagggatgcaaaccgtcatctgaggaacttaagtcagggagctgggttgtttagtgtggagtaaaggatctttcatgagtgagtggttgggggggtggtacatttcactccagatgtcaacagtcattgcgatgttggcactgctttggtcctgagtttcaagggaggaaattgaaggcttgagaggtgaagtaatttgcagaaggtcccctgaactcaggcctgactgtctccaaagtggcgtgtcagctgagggaacacagggtatcttgcagtcgtgatttctgatcaacacaagctgtccagcttcccaacatggccaaacaacaggacagacgtggctgctttccgtgggctctgttgcttctgatttatgtgtgtcttttctctttgagttgaagcattagaaggtgtatccaccaagatccagtaaagaagacagaaaacacaccaggtatctcaaccaagcggatttaggtggggaactggttttacaggctttcgaggggctgaaagggccaaaaggaaaccttgactgagacggtaactacaggaggcaggtgctgctgctagggctgggggaacaaatagaagaggctggagttacttaaatctagatggctagagaagggacccagtgagctggggcttgggccactgaggtagggacacagcctggcgcttgctggcaccgctgctaagtgcacagtgcaggggcctgggagcagaaggaagcaggagggcatgggggcggccggcagctgggaagggaaccatcctccctcctcgcctgccagcctccctggagggtgctggacaggtttgaacttcatgtggtagcagtaattttaaggttttgttttgtccccttgcaactctccttacttgctttgtccccttgcaacttataactaccttacacaggtactctgcattggtactctgcacaggtactcggggttattatttacatatgggatctgagcctcctgtgctttgcccgagttagggcctcaaggactttgtggatcccttcctgatcttttatttatttatttgtttatttatttatttatttattttgagatggagtttcgctcttgttgcccaggctggagtgcaatggtgcgatctcggctcaccgcaacctccgcctcccgggttcaagcgattcttctgcctcagccccctgagtagctgggattacaggcatgcaccaccactctggctaattttgtatttttagtagaggcagggtttctccatgttggtcaggctggtttcgaactcccgacctcaggtgatccgcctgcctcagcctcccaaagtgctgggatcataggcgtgagccaccatgcccggcccttcctgatctttatggcaagaggtttttgccacaacaacacttcacacctgactgaagcccagagaagcccacgtcacgatggctggaggcaaggaagaggatctagtcttttctctctcccagaggcgggagccttatgtccacatcactgtgagcctgctggccttgcccaaggactattcttttaaactaagagagtaaattaagatatttccgaggggtctgggatccatgtaaatgaaaaagttcaaccttttttgtaagccatgttcttaaaaatctgcatgtggggtagttaagtgtcacttactagagtcgaggatttcagcgcaggtctttttgaagttctgagatgaacttctcctcctctttatacttctcattccaaggatgctgagtgtgggattattcctgatgcagtgctgcctagggagaggagcctcagcacggcatctatcatgggctgctttgcttctgtatttagaaagagaactagaattttaaaataattgacttacaactacttagaaaagaaagggccaaatactatgtgcaatcatggcttcctcacggtcaggcatgtttcctgatctcatctcctttttcaggagactctttggaaatacatgcatatatttcattattgggaattaccaataatttaaccacttttgtgctattagacatttaggttgcttctgattttttaatattataactcatgttatgatgagacagtgtataaatctttgttcagatttctggttattttctcagtatggtttctggaagtgatagaaataactggataaataataaataacctttaggggaattggcacgttttgcaaaattgctgtttgggaagtttgtcccattttatgtgcccgctcgtggggtctgagggaggctttttcctggctcggctgccagccctgggcattgccatttgaaaatacctttgcaattaagtagacgcttgaccgtttcattgttttaattatacttttcgattattagtgtagttgagtatttttacatatgtttatgggtcagtttcattatgtttaattgtttatgcccttcgtccacttgtaagtaaaacagtgaagagtgacccgtgtggggttttttgtgttttgttttggagacagggtcccactccgttgcctggggtggagtgcagtggcataatcacagttcgctgtagcctcgaactcctcagctccagcaatcttcccacctcagcctcccgagtagctgggaccacaggtgcatgccaccatacccggctaattttttatttttattttttgtagatacggggtctccctatgttgcctaggctggtctcaaacttctgagctaaagtgatcctcccatctcagcctcctaaagtgctggggttgcaggcatgagccaccatgcctagcctgtgtggcctttcatactaggtgaatctgtggccacccacatcctgagaattgttttgttcctcttccaacctagaggaaggtccccttggaagtgtggcttggggctctgtgattgaacctttcctattcatcattttcgtcagtgtgttggatacagatttggaaggcgtgattactgagtgctgatgatataaagctgggaaggacaggtactaatgtagatgaaagactcgtgatttactccaatcttgaaaggatgacatgctggcagattgtggtaaaatataacagagatactttgaaagtcctgcatttagtcttccctttctctcccttgctcccttcctcccttgctttctttcttccttccttccttccccctttatttgtcccatcaattgcgtaaatgcaggtaaacatttagccattcctgtgaaagccgctgtgtatgtggtggccttaatcattgtccatttttgggcctgtggatccctgttattctctgcagtggagactgcacatcgggccagtgcatgcctgctattctctgcagtggagaccgcacatcaggccagtgcatgcctgctattctctgcagtggataccgcacatcgggccagtgcatgcctgctattctctgcagtggagaccgcacatcgggccagtgcatgcctgctattctctgcagtggagaccgcacatcgggccagtgcatgcctgctattctctgcagtggagactgcacatcgggccagtgcatgcctgttattctctgcagtggagactgcacattgggccagtgcatgcctgctattctctgcagtggatactgcacatcgggcctgtggatccctgttattctctgcagtggagactgctcatggagcatctgattttcttctggaccttctattttgagctgcattcacagagcacacctgagaaatggtggccaaggggagtgatctaggaccctgagaaacctggaagcagctccccttagggagagttgcagagggctggggatgttgaaggagagagaaggctctggaggaacttggatactcctttccaggctgagaagtgctgccctgggcactagagagggagagctctggccatggcttctgagggccagctgcaagtggacactgccatgggacaaacagcctcatctcactcattgaacattccaggaggaactaaatgacccctctcaggatgtcacgggatttctatgttgctggaaagatgcttgtggtggaagcgtggttactaggtggacctggattcagaggacagctcagctgattcctggcttgtggacttagatgggttgaacctttaaacactcagaacatcagtttcctgtaaggtggggtaagaatgcgtgtgtactgtgattgatgtgaataaaaggagcactgttgccaagtccctgagtgcagacccagcaggttggaaccacttcttttctgttccctgaacaattggactgtgtggacgcagatcctgcttccctgagctgcacggccctctctgatcgcacatacatgtgtgcatctgacacatatgcttgagtgtgagggtgacagcggtcagacaaatgggcttttttttttttttttttttttgagacagcgtcttgctctgttgcccaggctggagtgcaatggcgtgatctcggctcactgcaacctccgtctcctgggttcaagcgattctcctgcctcagcctcccgagtagttgggactacaggcgcccgccaccatgcctggctaatttttatattttcaatagagacggggtttcaccatgttggccaggatggtctcgatctcttgacctcgtgatccgcccgcctcagcctcccaaagtgctgggattacaggcgtgagccaccgcgcatggccaaatgggctgttttaaatctattagaaaaatttttcacaatttttagtctctattattctttctttttttttctttttttttttttgagacggggtcccactctatcacccaggcttgacagagtgcagtggtgtgatcttggctcactgcaactttcacctcccaggttcaagcaatcctctcacttcagcctcctgagtagctgggaccccaggcatgcgccaccacgcctggctaaatattctcagttatactttcagtacacataaaggcagttgtcaaccaagctgtttgttagaaaatgctaactgtggtccctgtccactgcctctttcctgttttttttttttttttttttttttgagacagagtcttgctctgttgcccaggctggagtgcagtggcgcgatcaccgctcattgcagcttctgcttccttggttcaagtgattctcccctgcctcagcctcctgagtagctgggattacaggtgggcaccatcatgccaggctaatttttctacatttagtagagatggggttttgccatgttggccaggctggtcccaaactcctgacctcaagtgatctgcaagccttagcctcccaaagtgccgggattataggtgtgagccactgcgcccagctgttcactgcctctttctgaggcctgtcccacgtgggaccttgtgagctggtggaggcctcttgagggctggcaggagcctgtgctacctctgggcccagcacctatgctcccgggagccgtcccgcctcttgccttcagtcttcatctgtactgtgaggatcatccactggcctcccaacccggtagtgaagggggaataacaaggacgtctctggaaagtgctgcaggttcccctgaggaaagctattgtagagtagaaacgagaatgcacccccggaatcagctctccgatgatatgcaggtgcagctgcctccagccctgccgttggtcaggaggaggcaaggggtacctaatgtgctcttatttggcccatgatgagtggagaaagagacctttgcccaggtgtccatgtcactgaggcagtggcggagggtgtcccccagctctgcagtggtcaccctctgcctcctgtcctcgggcagctgcctgtggctgcaggcggtgaaggtgctgttggttgtttgctcccagacctggctgtggggcctgctctgcagaggtcaggggcatggcgcagggggacccagcagggagctggagccaggcagtgcgggctgagccaggccgaggagacccccgcttttatcttgagtgttgtcatctgatgctgagttctttctcagcagtgaaggggaatcagtgtcctgacttgaattgcactttgatggggtttttagtttctgtgtgttggatttttactgagagctctagagaaactagtcacctgggggtttcagaggagggttgtgaagtgctgaatttttctttgagcttttaaggtcagaactcaggggagctaaaaaaaaatgaaaaaataataatttaaaccttataaggtgactcataaataactgcctttcaagatgagtggaattcttctgggaaaaagccctgtggaaattctcctgaccaccgagaacaaagaggaccactgctataaaaacctccagaatcatcatctgcggatggagggaagactctgccaggagtgcgatttttcctttatgtgttactccgtttaccatgtctcaataaaatggcagagaaagtccttttcctgtgtttcatttttcccacaacctttccccttttgacttctttggggcttccccttatctgagactggcccaccgcagaattcagcttcacgggcctgtccggatggaacgtggacgccatcatgtgtttactgcttttatctcttagccacttagaaacattgttaccatgagaaaatgggaattatgctttgatccttgagttaaatcgaggctgtggtagctggtgagttatgaggctttattaaaataaatgatcttggatgtgttgggtattcactggcaagatgttaccagaactcaaacatttaagataagccacatattatttgtatggattcataaaatatagaaagagcgtgagctggctatggctgggttttgtatcctttcccccaactctgttacacttttctgaaagaaaatgagactttgcttttatgtgaatagctgtagaaagctagggaggggtgccatttggaaattgaattaaaaccaaattatgtaagaatgtggttagttttataatatcctgttcttgtttcagtgctttggtttattattattattattattattattattattattatttttgtttttttttttcctgagatggagtcttgctctgtcgcccaggttggagtgcagtggtgcgatctcgactcactgcaaactccgcttcccgggttcaagcgattctcctgcctcagcctcctgagtagctgagattataggcacgcgccacctcgcccagctaatttttgtattttttagtagagacagggtttcatcatgttggccaggctggtcttgaactcctgacctcatgatccatccgccttaacctcccaaagtgctgggattacaggcgtgagccaccgcggctggccggtttattattttttcctcagtgccgtggaggcgcacagggctgctgcacccgttagggtggccctgggtcctacagccccgggcacacggtgcacagcacttgcgtagggtggtcctgagtgtgcacgctgctacgtcgctcaggcttatgtgccttaagcagttgcatagtttaggcacagtgctgcttctcaaagtgaattctacttggagccacttatatatagattagattttataatgtgtaatatgaagaggagcctggaggtatacttaatttaggaattatattatttttggtttgggttttaaagtatttgaatgcctgttaaaccaattctgtagtggctagaggttcaaaatttgtagtatttatgaaaaatactcattctaagtctgcttccttttataatttaggtatatacactctctgttcagaattcctcaatacaacgcattaaatattgttccgaggtcttctgagccccgttctcagtggtggccgtgagctaacatttccacatctgtcacaatgttgtttgcagtttgtcgggaggcgctctgcagccaggcagatggaggggccgctaggcaggatgttgcgagtctgtgagggcatcaatcccccgtttctggcatagatttaattgtttggttcaactgggaagccatatattaacttctacttcaacccatcctgatctctccacagatgctagttttatacaggcctatttttctctgaaattgagcctgagagacaaaaatccacacttgggctgtcatagattttggtaaattgagtcttgtgactgattggtgcctcctgcctgccccgtgatcctgtatgtagtaaccacgtcgtgatcacaggtcatggattggggaaagttgcctccaaagatgtgggtgtctgtttttcactccactttccatttggccaaaaattcaacacttcagtttctgtttcaaaaaagtaacaaagaattaaaaggaaaaaagcagtaagaaagtttgggccatggtggtgctctggtacccgccttcctgtttctgcctgtgtcgctctggctgggcagggtccgggcatggcagccctcccctctctcctccccctctgccatgggggcctgtggttcagctgccaggcgggaactgaagagcagccccgggcgctgcagcttcctgtcctgcccatcacggtcagggacgccggtgtccgttccttctactccaagtctgtcccgagtttgaatgttcagatgccaccagcagctctttagggtctggaccaaacgtctgatttttcctctactaacctgatatgtttctcatggcctttctcgcctttttgccatgtgtgatagctgttcctgttccttggactggattttcacgggctcgctggcaagcaggtcctgcatagcatgctcagcatgtagctgtgctccgcgtctgccggatgaacacacgagccggtcatgggccacgtcagcaatgttctcgacctttgtaagcttcgagaatgtgctgtgtgtacagaaggacgcgcagccaagtatgcggtggaatatccagaaacaacacggggcttgtcgggtgcagacggggcgcctcaccggcccggcgcagccccgctcgcccctctggcctcccccgcagttcccctttcctggttgtgcagcatgcactcgcttgcctttttcttttctcacagttttatcaactgtttgtgcatccccgaaataatacagctttgcctggtgtggaaacgtatataaacattatcatagtatctgcgctcttttgtgtcttgtaagacacccgagatcgattctgttgccgtgtgtagcggcggttattcttgctgttgtcgtgagccattgaatacagtgtcgaacacttgggttgcccagtgtgtgtgtatgatgaatagtgctgctataagtgtttttatatatgaattttggttagcacctgtgtggattttcgggaggtagttgcctaggagtggaattgcgtagtaatcgggttgggttttagctgaggttgtttctgctgcaccacactccggcccacactgttacgcatttttactgtgttcattcctgtgggtatgtattatatcatggctgtaatttacttccccctggccccgactttgaaaagttgtatttatttatgagatacaatgtgatgttttgatagatatatacattggggaatgattaaatcgagcttattaacaaccatcaccacacatatgtatcttttttttttttggtggtgagaccatttgcaatctctttgcaattttaaaatatatagtgttattaactatagtcagcatgctgcatagtagatctctgaacttactctctgtccaactgaaggcttgtgccttttgaccaacatctcccctaccccttccacccactaacctctggtgaccaccattctactctgcttctgtgagtttcgtttttttagatttctcatgtaagtgacatcatgtggtgtttgtccttctgtggcttatttcacttaacgtaatgtcctcctggttcatccatgttgttgcaaatgacaggatttccttcttttttttaatggctgagtagtattccatggtgcatgtatatcacattttctttatccattcttttttttttttttgagatggaatctcgccatgtcgccccggctggagtgcagtggtgtaatctcggctcactgcaacctccgcctctcggggtcaggcaattctcctgcctcagtctcctgagtagctgggattacaggtgttcaccaccacgcctggctaatttttgtatttttagtagagatggggtttcaccatgttggtcaggttggtctcaaactcctgacctcaggtgatctgccctcctcagcctcccagtgttgggattacaggagtgagccaccacgtctggcctatccactcattttttgttggacaccttggtacattccatatctcggctattgtgaaccacactgcaatgaacatgggtatgcagatgtgtcttgaacatgccgatttcaattcctttggatatatatacccagaggcagaattgctggattctatatggaagttctgtttttcattttcattttcttcatgactaatgaaattacacaccttttcatactcttactggtgattttgttaggatcttttgtgatgtacctgttgaggatttttgcccttttcctgttgtattgtttcttattgatttgtaggaattctttaaacattctggataacgtccttttaaaatgtgtttatatgtggaacatttcttgtcctgtgaaacatctctgtgatgcaatatttcagtctttttatggtctctcttgataaacagaaatatgtagttctattctagtttaatgtgtaagtgctttccctgtgttttatgcttgtgttgaaatattttccaaccttaaggtcaagattttgtcccataatgtaccctaaaagcttcatagttttgttttttacatttaggtccctaacgagggtgactgccagtccctgtgtgcccagggcagtcctagggatgaataattaccatgtattaataatcacgccagtctatggcccatccggcattggctttgcatatggtatgaagtaagggcccagttttgctctgttgcatatgaattttaatttgtcccagctcctttcacttgcagggactatgatgactcctctgcaggccgtctttgcgggaactaagggctgagacgcgcctgggtctgtttctggccctttgtgctgttccgggggtacttctctctgtgtgccagcttcacactcctgtctctgtggctgctgatggtctgaaaaagcacatctccccatttggatcctccagagtttcttgactccctgtgtccctttgcatttccatagaaattttaaaatcggtgggtcaagttcactgagaggcagaaaaacatattgaggctttgattgtgatttaatcatatctgtaggtccatagatcatttaggcagagacttgacatcttttcaatattaatttttctaatttttcatgtagaagtttttcacatcttttgttagatttattcttagatacttttgttagatatattcccagaattttaaaatgctattttgatgagtcttagaaattgtgtgttgtttgttctggtgcataggaatgcagtatacagttttcgttttgttttttttcaatcgactgatttgtatccagcaaccttacagaatattttaatttgaatattcacatatttatttggatttctataaacacagtcatggtcttctgtaaataatgacagtccctcctaccccatctttatactttctctcttttttctatctgtgctacactgaccaggactagtgttgaataaatgtgggggcatccttaacttttttcttatcccaaaggggaacacatttaccctattaaatacgattttttgagctaatttcgtaggcaatctccatcagattaaggaaggtttctttcttgcttataagcgttatttctttaatgagtggttattgaattttagtaaatgcttttttgtgcatctatcaagatgatcatatgctttttctcctttaatttgttagcatggtaaagtaggcatgcaggtatgcgcacatgcgtgcacacagtgtctttaatggttgagctgtgtgttagcatggtgaaggaggcatgcaggtatgcacacatgcgtgcacacagtgtctttaatggttgggccgtgtgttagcatggtgaaggaagcacgcaggtatgcgcacatgcatgcacacagtgtctttaatggttgagccgtgtgttagcatggtgaagtaggcatgcaggtatgcgcacacacgtgcacacagtgtctttaatggttgagccgtgtgttagcatggtaaagtaggcatgcaggtatgcgcacatgcgtgcacacagtgtctttaatggttgagctgtgtgttagcatggtgaaggaggcatgcaggtatgcgcacatgcgtgcacacagtgtctttaatggttgggccgtgtgttagcatggtgaaggaggcatgcaggtatgcgcacatgcgtgcacacagtgtctttaatggttggggctgccttgcatttcaggtataatctgtctacactttttatgcatttctgggtttggtttaatatttttgtaactctttttttaaagtaagtgacctgtaattttttcctgtacagtttttgttgggttttaacaccaaggtcatgctattccaaaaatatgagtttgaggagtgtttttctattttttttctgcctctggcttttagcaagatttgtagaacttccagttactcatctgggtcttgagttttctctgtggaatgatttttttaaattatgatttgtttctaaaatgattatcatgtcttctatgcctttatgagtcagttttggtgagttgtgtttttctagtacttgtctttttctttgttacttaaaaagtttagtggcatagagttgttcaaagtcacctcttgtcaatgtggatagttctctcttttagaattctgtaccgtggttttgcctgcctgcctgcccagccccctcccctcccctcccttcccttcccctcccctctcctcccctctcctcccatctcctcccctctcctcccctctcctcccctctcctcccctctcctcccctctcctcccctctcctcccctctcctcccttcccttctgttcccttcccctcctctccttctttcttttctttctctccttcttttttttggagacagagttttgttctttctttccttcctttctttttttcttttttttttggagatggagtgttgctctgtcacccaggctgtagtgcagtggcgtgatctcggctcactgcaacctctgcaacctgggttcaagtgattctcctgcctcagcctcccgagtagctgggactacaggcgcacaccacaacacccagctcatttttgtaattttagtagagatggggtttcaccctgttgcccagggtggtctcgaactcctgagctcaggcaatccacctgccttagcctcccaaagtgctaggattacaggcttcagccaccgtgtccagcctttctttcttgattagtcttactagagcaggcatggggatgatagtgaaaatgttgctttttatgaataaagcacagaagtgtgtgcagtgcacaaacagaaacatcatatacctgcgatgtcaacatttcatgggagggggattagggaaaagattaggggaaagattgggcgataataaaatagaggttgagagtcactgcatgagaggctggttcttttcagggaaccagcttgtggctttgtggatcttctttgttatctgtttgctttcattctgtcagctttggatccttccttccttttactttctctgggtctgtcttcttgtgatggatgcttactcatcctcagctttctttcttctcttacatttgtattaatggctatacttttccctcccagtgcagctttgctttttcccactgggttttatttgtctctctcatttgaagtaggctggagcgagtgtggcctagttcagaaatagaaggctggtttggctgtagctgtgagtgaggaggagagcagtagattaggtaggagagagaggcctagactaaattgtgtctgggcttgcagacctgggtaaggaactaaatacaactcaggtgtgctagagatccgctgtgtggtttcatgcagggggtgttgtgatctgctttatatttaagagactagagtaagggatcgtaggggtaggagtggaagggagaagagtgctcagaggctgctctagtgcaggggcaagacgctggaggcttgccctgggtgtgatggcggtgggaggacaggttctggatttgtgtgcatctgggaagggaacaggatatgactgcccagttcagcaagctcgtttaggatacttttattgggcagctcattaactgttctctgtggcccagtggatctcagtaagctggagctttgtaattttcacttatctctatgattgtttagtgtcctaacagaatgggagatttatttgggtaaagagggcctagaaacatttaagtattcccgtgatgctggccataaatacagaaaatttggtgcagtatgtcttcacattcctacaaatttagtgtagttcagttctcaaaccatgctggtagtatcctgggggtcttcaggacccttttgggggtttgtgaggtcggttgctaggacaggcctgcgtttccctggcgcctggatctgcactgatggcgggcgcaatggcgggcagtgctgtcggagtcttagtggctcccagttgacccagtcgttgcatccatgatagcctcataactggccgcaaaaacacactacttgtgtcaaatctgggcccttctgcacgtgtttttaccccactgagtgcctttgcacagactgcgatctgctggttgctgagggacaggcactagtgggatccgggaggggcctgttggttttccccgtgggatgctgcttttccctgaaagaataagagacaggatgaagtgagcttgtcacttcaaggaaaacaactgatggcaattgttgccagtgataaaaattgagctttcaactgtaaattaaattagaattttaaaaaacctgtgtcttccacggtgaacttgtcaggttaccagcctgttctgaggcctgttctgatgagaccgcggcggccatgctgggtgtgtttgatgctgcagaagagctctgcacagctcggtgagcccatctttccacatgaccagtgcgtgctgttacaacaccatgtgtgggtaaagagccacttcaagcaccagctaggacagagggtctcaatgtaacagagtatgaaaaagctactgaaacagtttccttatccaacaaaccgcttgtggagttttggtgtgtatcaaacaatactgacaattatttcaaaagactacgtatacatgtgcagctccatatgtgatgctggattttcttcctgtgcttcagttgaatcaatgtattacagcagattaaatacaattgcaaaggtgagaatccagtgacttctattcctgagccagacagtaaagagatttgcaacaatgaaaaacattgccactcttttcactaaaattttttgtttgggaaaatagtttcatttttaataaaaatgtcattcatgttaacctgtaacaggctttttattgttaatttgaaatgaattaatacaaatgagaagaccctcatttcaatgtataacatggtaacatttggtagtgataattgggaaggggcgtctttggactcctccgtgattctaaagagtgtgaagggaccttgagactgaaaaatccgagaactaccggtttatagaagtggaagcatttagtgatattgccgttcgttcctttctttccttccttcctttctttttttctttcctctttctttctcttctcttctcttttctcttttcttttctttcattttgagacagagtctcgctctatcacccaggctgcagtgcagtggtgcgatctcggctcaccacaacctctgcctcctgggttcaagccattctcctgcctcagcctcccgagtagctgggattagaggtgcgtgccaccatgcccggctaatttttgtattttgagtagagatggggtttcaccatgttggccaggctggtcttgaattcctgacctcatgatccacccaccttggccgcccaaagtgctgggattacaggcgtgagccaccacgcccggccgtgcagttctttaaacgtaggaaatgacctttgagttttgagttcgataccagcgtttctactattaaaggtggactttctctgtcaatgttcttggaatcttatgctttccacgaagtccttgcacttgtgcagaactgtatccccttagccatgtgaactgcacggagcaacgctgttgcaggatttccttctgcctcactcagaacatatgtgctctgtgtgtgaagaagctcgtcaggctgtgagcacagcacaagaataaagcctttagaactcagcagagagaaccagccattactgaaaatggaatgttttaattaaaaatatccatcaccgggtggctcttcttttcctttatttctcaagtgtggcaaatgttaataacagtggctgcactgtggctccatggtaaattgccagttggtgagtaggatttctcccatgaagcttagagatgaacccctgcaacatctgttcttgtgacaacgaatcccttttttactttggcttatgcatatttcagaggttagagacaggaggctccttctaaaagtgttcagtaactgcctgggctgatgtgtgtgcctgagagtcagagagagagagggagaaagagaatgggggctaaggggaacaagaagggagagagagagagagagggagagagaatgggcactagggagaagagaaagagagagagagacggggaatgggtgggagcatatgaattcattggtaaccctttcactttcttttcttcctgtattaattgatgggttgaccttattaagtgggttgattttggggtttctactgcagtgtaacaatgagcatgcagatggattttctgattgtttacaaggaaatcaacctttacactagctccagcttttttcttaaacatctagttctattagaaaaaaagcaaaagcacagcagatagaagtcttgaagcctgcagtaaaacactgtggctttccattgtgaggacgtgcctgttctttattacacacaggctgcttctgtgatctgctgagttgggcagtgtcatcttagcagacagggtttttccccccccttagatggggtctcgctcattcgcccaggctagagtgcggtggcatgatcatggctcactgcagcctcaacctcctgggctcaggtgatcctcccacctcagccttctgagtagcagggaccacaggtgtgcaccaccaacatctggctagtttttaaaatatttgtagagaccagggctctctgtgttgcccaggctggtctcaaactcctgggctcaagcaatcctccaacttcggcctcccaaagtgttgggattttgggcatgagccatcgtgcccagtggcaggagggtttttatgtacatgtgcttgccctttgtcaggggggtggggtgtggctttggttttgatattttcactggtactgccaggctattttgattcttcttataggagtcttgaccgtcaaccacctgccatgctgtttgggatgcagtgttttgaggatatccctggggactttactaaatggacctatacaagttgataggccttgacaacttttctcttactgtagtttttgttttattaccatttaaaactaaaggctagggagatgagccgtcctagattgaacgtgcttattagcgtggatatgttgtgaagaaatgcacgttggaaaacatggtcctccagaagcaattaacttggcagctattttgtttacattttctatgattaatatttacattttattttaagaaaattggttttttgctgccttgatctcatgctcacattttcctggttgagattggaaccaataagtaaagaaaattgacctatcaacccttttaaatgttagaaacctaagtcagagagaactgtgttaaaagaactgtgtttatctttttggttaaacctgttgtaacactgtgtggttaaattttccctttgtgctctcttcccctaatcgttcaaaggatagtgggcactattaggttcgacttttttttttaaatgtttatcttagtggtgggtcctcttatgggctagtcatttgtgggcataggttggggtgtgcagggtttatggctaattataggatcatatgtagtggttctctgtgatcaggagaaggataccaaggtttctattttacttatttattaggttgtgtaacttttttcttttattcttttatgcttgatgatggtgttggtgtttaggaacccctgtttagaaagcattttggagaaaacctgatgcaattttaattttgatgatgtcaatatctcattagataaggccttgataaaataacacctttttctcttatttcaatggatccaaagagaggctagcttggaagtggagtggtggtgatcaggaagggactcaccaccacgccacagggttgtcacatattttcctcaaagcaaaatgtaatttcctcttaaaagaggatttagatcctggcattttagcagctgtttttaaggcctggagctttggtattcctggctgttttgggaggcagtgctggacagccgattcgttcagcaggtgttgattgtgtgctgacttttgtttggcagtatttggtctgacatgggagggagtttgcaagaagcttacagcatcatttcatatggttggaaccccaagtgtgggactagcacacctaaaacagggacgcacagaaagggaaggcagctgtgattaaaccttgaagctcgtagtaccaagctcaagcctcggcatttggcagtaggagaggtgcagaatggttgggagagcctcgtagaggggatggaacttgagctgggacttgaagaaggctgagagaagggacagggaatgcggagtttagggagggtgttcacagagattttgagaggaaaccgagcatggctttttcatggaactgtgtgagtgtctgcatggcttgggtggggatgactaacttgactcaaattactcatccctgggccagactgcggtagcctggggaccaggtgaaggaatctcaaccttatattgtaaaggcaatggggagcagtgaaagttttaaataggtgaaagataggctttgttttctcttttctttttcttatcctttttgtttgtttttgagacagggtcttaccctgttgcccaggctggagtgcagtgcgatctcggctcactgcaacctctggctcctggctcctcagctacctaggtagctggaactacaggcatgtaccttcacacccagctaattttttgtttattttttgtagagacaaggtctcactatgttgcccaagctggtctcgaactcctgagtttaagccatctgcctgccttggcctcccagagtgttgagattacaggtgtgagatgctgtgcctggccatgttttttttgtttttggttttttttttcctaaagattcatctgactgtatgtggtgtttcacacctgcaatcccagcactttgggaggctgagaccagttgatcccttgagcccagcagttcaagaccagcctgggccacatagtgaaatgccatctctacaaaaaaattaaaaatattagctgggtgtggtggtgcacacctgtagtcccagctacttaggaggctgaggtgggaggatctcttgagtccatcaggctgaggccaccgtgagccgtgatcatgccactgcactctagcctgggcatcggagtgaaaccctgtctcaaaaaaaaagattcgtctgcttgagatgtggggcgtgtggaaggaagtagaccagtggatacggtcacccaaagcatgatgggaattccagatactatatgatgccatttcaacatggaggagtagaaatggtgatgaaggtaaagagaccacagcagagaggcgtctagaaagaaattaatggctctgacaacttatttaatagaagtggtggggtgtggggcagcccaagataacaaatgtaattttcagggcaattcatggatggaggaagaatcaattcagatttctgggttgtactgtttttgatattgtattctaagatggtcattgcttcttattaggagacaaaaaggtttttaaaaatgtgaaggtcatctgcagttttttggggtgagagagtcctcaggaacgttcgcatttgcagatgcccaagagccttgagtccaagttgctgatcttttgcgcagggtggttctgccgcagtctgcgaggcttctggagggcctcgtgagcttgcagctctgtgatcctgctgacaaactggtttctttccacatgtggaatctgtgttttccctgcatggagcagtgaatggggatgtgaaaggcaccggacatgaagctgataccgtcacagtagaatccagaagagctgctcagtaaaacagcttatacattaactgttcagacgctagaaaaggcttgtattgcttattgaccttaaactttcttgattctttctatctatctatctatctatctatctatctatctatctatctatctttttgagactgggtcttgctctgttgcccaggctgaaatgcagtgttgtgatcactgcagcctcaacctcctgagctcatgcagtcctcccaccccagccccccgggaagctggcagatggtgttgtcctcacatggccacaggcaagctcttcttataatgtgaccttgacacttctgccattgtgagtagggtccctgttccctcccgttgaatctgggctgactcgggactgtagaccaggttataaaaggctctcccctggatctgctggggcgtgtgctgtgaggaaaccccgcagccatgcggtgaggccctgtgaaggtgagccaccatgcagtgattccagcccccagaagacactcacccccagacttaagtcttcccagctgaggccccctgagacctgtggcgccctttcctaattcttgaccatgggacctgtgagcataatgaaatgattgttttgtgctgctaagtaaagggaggtttgttaagcagcagtggataacttgaacatgttttggaagctggagccaggtgtggccataatcaaatcccaatgcctgcagctctggctttgggatggggtgttgggcagaagcctccgggcctccaggagagtgctgctggctgcctgaagggcctcctagaaggtaatagggtctagtattttagcctgtgggtggcacatgatgactgtccctgctactctgccaatgtgagaaggcactgcagacggtgtccaccacatgggtgccctggatttggtcctcagcaggctgggcttggcctactggctgccttttgcctaccccggaaggaaaggagggaacgtgtcattgcacgctggaggaaaggggccccttgttaggtggtggtgggaagcctggtgtcattgttgctgtgggaaagaggaaagtatgtgtgtatttaatgaacttgctcatctagtttaggagatttccaggcagaaaattcaaagtgccacctggcttctccttggtgtaaaggaagaggacttcctgggttcaaaaataagactgtttctcattcccagcctcttctccaggctcctcaagtgaagaaagggcttccggcaaaatgcatctggactgggctgtgagctccgttcctaaggcttcagattgagatccaagtgcagtgtctggcctttcagctggaggagaggcctgcagattcttgcattaaatcccgtctggcctctaagagtccaaagggcgttgtcatgccacagcctcttctgggagcccaggaggtaaagggcttgtctctttatgggtgtggcttgtctaatggaggagattatgagttaatacacaaaaaggccaccaagtgtttttaaagaaattatgtgtctgcctggactgaaaggagcagaggcaatacaaaatgaaaataagtctttgggcccccagacttctgtgaggaggaagcaggctgtgaaaatcacccagctgtaaatgtggggtacttttcatggaaaatgaagtatatctgagaaggcggagctgagatcccagaaaacaagccccaggtaccaggacagagccctgatggaggtgctggcgctgtgtgcctgcctcgagtggctgtcctgggtgggacattgtgtgtggggtgtgggtgtgtctgggtcagctctttagacctggattgggaagaacggggatggaagaggggtggacttgaggaactgcatgttcctgcacacaggcttctcagctgggcagggtttaggtgacgagaccccagacttcaagctgatagcagtaatcggacaggccttgggggccctggggaggtgtcaggttcattttgcatgtgggaggatgtgacgtgtggtggccagaggatggacagtggcagatcgtattttccagagatgaccgcagcagcatctcccgccgcacgtgccctctctgcagtgtaactgtgaaacgcctcccaagatgaccgcagcagcgtctcccgccgcacgtgccctctctgcagtgtaactgtgaaacgcctcccattgagaggcgaagttgctgttctttcccttggatctggatgggctgtgactggatgggaaatggcgctcttggctggtgtgctgaggacgacataccgttcacctggttctctcagaacccaagaccagccccatcggagaggctgccagaggaggccatgggaggaggtggtttctcattaacagcgaccaccactgtcagccgccagatgtgtgagtggtgaagcttctggtggtgccagtgccagccactgagccatcaccggcctttgcatcttgcctgctgaggacccggacattgtggagcagagacagggtgtcccctcccttcccttcctgaattcctgcccctgcaggaaggagaaaatgattgctggccatcactgagggttggggacctggctgtgcagccgcagcgccggcgggccgctctcccacatctcaggggcacgcaggttccgtgccagggatggctggtcaggccccgcagatgggcagaacttctcatcccacacatcccagccttctttaaacttccctggcagattattttatggttttgctgctgttggtgaagatggttcagtctttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccggacagaggggctcctcacttcccagtaggggcggccgggcagaggcgcccctcacctcctgggcagggcggctggccgggcggggggctgacccccccacctccctcccggacggggcggctggccggtcggggggctgaccccccacctccctcccggacggggcggctggccaggcagaggggctcctcacttcccagtaggggcggccgggcagaggcgcccctcacctcccggacggggcggctggctgggcaggggggctgacccccccacctccctcccggacggggcggctggccgggcggggggctgacccccccacctccctcgcggacggggcggctggccgggcagaggggctggttcagttttcttttctttttttttggtgggggggagttttataactttatttgatgtatttgatgatcagcgattagttctcatccacattgactgtctgtagatttttgaacatggtaacaggtacataggtaaccaaagtatagaacttatttggtgaatcttcatcctcattacattttctggataaccacgcacggatgcggtaggggacattccttattcctttggcccagacagctttgttgagcctggtgtcaatgcacacatctggagttgccatctccttcatgtcaaatttccgaatctctctgagtgcccaaggggcacgcttcatgaagcccactccgtggacgcgctggtgaatgttgatggtgtcttctcgggtcaccacctcgctgattgcagaatggccgtttttcttctcgccatccttttctgcgggagccattctgccgggtccaagttggaaaggaaaaggacagttgagttttcttgggttgtccattggatgatcatcccagatgggttctttgtacttctcgtgttcacatggtttagggatgtttttctgatgagtggtggaaagtaggaactattcatggtggctggatttggcgcctgtctccctcatcatgctgtttatttttgtcatgaaaaacatctttatcaataagattaatctcacttttacccagacaatgtaacctgtagacttcgttgagtaaaattggaaataattttaaatctaatttatcttgttgtcaaaccaagagaaacctatcaagaaaccgctaaagcagtgagagctcagaatgaggaggtcgtggcataaaaggtgatttttctgggagcttcacatctaggcgatggtctaatttgtactaagtgcgaacacgcattgaattcagggaactgggaaagcacgcgtgtttgaccctgcgcgctttgcaagaagctcgtgggggttggtgcatcctttgaagggttaagggaacgaggggtgaaaagttgattattgtttggttgtgcaaatgtggtgctgggtggagtccccaagaccacttcctgcttccaggatttactgggagtactcacaggactcaggatctaatactcatgggcatgatttattacagtagaaagataacgaagcaaaaccagctaggcgaaagggtgcatggggtgaggtctgaagggaaccaggcacaagtttctgaaagccccgcccccatggaggctcacaggaggggctaatttcccccagaacaaggtagaccaatacaaggtagtgaaatgttgccagccaaagaagcgcatccgagacttagcccccagggtttttactggaggctggtgacaggtagcctttgccaaaatcccagccttctggcaggaaagcaggcattcagcataaaccatattgttggaaaacagttgaggcacagcgaaccccacttactagttagggtggtgggaatcctccagaaatccaagtccgcagaccccagccacgggccacccctgtaagcagggctttgaaaggagggctgctggggcctgctttcttaaccctcttctgcacagataccaacttatcctttcctttctgattaatgtctctcaaacacagacgggggaataaaaacctgaaaacaagcgaatattgacatgtacatcaccactttcaatcagctattttcaaccaagtgctgaagtataatacagttgtagtcacaaaggggaagtagcaggtatgttgcaagaaaaaacttattagaattgtatgttaacttggatagaaacagaacttttctgagcttatgtgctgtgcagatacagaatgctggcagagttacttctgtgagaacatcattgaattacaattaaatattaagtacctataaaatatctttgcattacaaaagtggttaaagtaactttctcagtcttcataaatgtagatagtatctttggacaaaataatgagttagtcttttgatggaacaggagaagcaggagaaaattgttccaggagcagggttgctgacgatgctgtccctgttggtccagaaggtaaaatcctcctgtattagtctgttctcacgccgctaataaagacataccagagacagggtaatttataaaggaaagaggtttaatggaatcacagttcctcatggctggggaggcctcacaatcatggcagaaggtgaatgaggagcaaagtcgcgtctcacatggtggcaggcaagagagcttgtgtaggggaactcccctttataaaaacatcagatcttgtgagacttattcaccatcatgagaacagcacaggaaagatccatccgcgcgattcaattacctcccaccaggcccctcccacgacacgtggaaattatgggagctacaattcaagatgagaacacagagccaagtcatatctttttttttttccccttttttttttgagagggtgggtcttattatgttgcccagctggtctttagctcctgggctcatgtgatcctcttgcctcgtcctcccaaagtgctgggattataggtgggagccaccacacctggctgattttctcttatgggttggagtaaggtatggccaagacggttaagacgatccatgtcctgtgggatggcccatgtttcaccagcactcagatgccctggggctcggggcttatgggcagttttgctaattctcaaagttaagttttcagctgggtgaagaaggaagaaaggctgtttcgttgaactcagtgttgaggagagcagtgactgacagcagtggatgtgctctcatcctcctgcttttactgggagaggggctttgtgatggcaggtgtataacctctcaggttttatttcttttacattaagaaaaaagaaggtggggaggtggtgggtgacagagcaggtgatacgtgagagtcagtgaaaatgcactgctgggagctagagagcctgcgcagggtttttccgttactgtgtccgtgatgagttgaggaaaccgtgtctcagttctggaccatggccgagaggaagtgcatagtcttaagtctcttatctagtgatcatcaacacaaatggggcataccggctgcaaaacagagttgggtaccagtgaggcctagaccacctgggcgtttctcttccagagctacagttcctaggtgtaaaatagagctggtgatatacaccttgccaggttatttgaaaatgcaaagcacccagcacagtgcctgacacatgggaggcagtcacagacccatctgtgctcagttgctcatgacgaatgcccgttatgtctcaggcacggactagctgtgcagtaagagggagctctgagtcagacggagggtggatttgctctttgggcactggtgtagctctggatctgattgtccttcattatctaggttttggaaatgtgagtcattatgtaaagcttgaggtgttggtaggtgctaggtgaatcaagtgtggtggtggtgttttctatgcgtgtctcttaccaatagacttttgtttttgttttttgagatggcgtctcgctctgtcgcccaggctggagtgcagtggtgcgatctgggctcactgcaagttccgcctcccgggttcacgccgttctcctgcctcagcctcccaagtagctgggactacaggaacccaccaccatgtccggctaatttttgtattttcagtagagacggggtttcaccatgttagccagggtggtctcgatctgctgacctcgtgatccacccgcctcggcctcccaaagtgctgggattacaggcatgagccacggtgcctggcctttttttttttttttttttgagacagggctttctgagactccaggagtggtctatcatgccctgctaatttttttattttttgtttcttttagagatgagtgttatgttgcccaggctggtctggaactcctggtaccagtaaactttttaggaggtttccgttagcttttgaaaattttttacctgatctttaaaaatgaatgcagttgtgtagcaatttttaaagtgattgacagttttttcccaccctaccttttcttgattgaagcagttgattaaggattttgggagtggtcctattgtttcttgtatttttctgatttttgttttagtgatgacactgtgggaaatcatttgtcaggggcaaatttcaatcttctgtctgaatggatctgtctacttatctgtccatttatttgttcactactgtttacctgtctgtccaaccacctacctacccttccgtctggccatccatccatccatccatccatccattaaagttctttttgggggtgtgagtatccgtttaattgcactgcatatctacctacaagtcatacctcttagcaatcagcaggcaatgaatcgggccattccctggttgaaattcaacttgagatttctagagggagctactcaggttaaggatgcattatctaacaagaaaaatgaatctacagtaggtcgtattacagatgcagcacatgaaggcgcccacacattacttcttagcagctgagtgtgaggtgcatgcatgtgaggctcagaccccacggtcttagggcatccttcaacttttttttttgaagaggagtctcactctgtctcccagactggtcttgaacgccccccttgcctcaagtgatcttcctgtgtcagcctcctaaagtgctgggattataggcgtgagccaccgcgcccagctttcttcaacctgaaaactatttaaacattttattactctgtagctgttggcagtaccagattttatttacaactgaaggtagttttggatctaaaaccacagttttggtaatgttcaaaaaatggatcatttagtggttttaatgtcatgtatcaatcgttttcagagtatcttttatattgctcttctgtatatgttagcttactagttgattagtgtttctgtaacctgtcctgctttctaatctagccactaagtggttggatcaggatttatactcagctatgcctcctttaaaactgatgttttgtccctcatctccctaaagtttttaatggcatatatgtgtatatatgccatttatatatatatatatatataattatttttaagttcattttgcttttatatctccccgattttttgacattgtttgtttagagaaatttggccacagtttttagcactgggtgctgcaggatgagggctggacctgctgcttggagctgcagtcctcatcaggtacctgctcgttgtaccacctgcaccaccacccacatgctccccaattttttaaagttaattaaaccccgtactgaaggtaaaaatatgtatacataatttttattataatgctacttaaacatataaaacccaaggctaggcataaattccttatggttagaggaattttgtgcagctgtaaatcccaaacatacaaattcagtccaactacaaaggcagtaaatgaacacaattaatttaatgtgacaaaaggatgtagttttgctgacggtgtattgctaatgttgggtttcatgatacagtgtatttgtatttaagatttttgcttgctgtcacttaattcttttgattttgagagtgatagactctctcatttttcagtttactgagcagggttcccccactcctgccacctgcccctgcccgacggcgcagcacagtgacagcgacttttcttgtgtccatctcccactttgttcaaatggcagcaaataggaatttatgatctcatttccctcctttccttaggagaaaagtaatattctatatgcattattctgcaattttcttttttcatataacagaatattctcgaggtcttccctatgagtgcatggaaaactttgtgggccatcattggagttgccgtctttacagccgttgttttttctaacaatgtatactctaatctcattagaggtttgtcaccgataatccagattacgtcttctttggccctcaaacaaccctctgaagtaggtggcggtgggggtatcaggaagagaagaaactgagattcagagaggttaacggacgtgactgaggcgacagatggaagtgtgtggggacgtggcccaccctaggtctgtgtgcctagacaaaggctgggtgcattgctgccttctcagggccactgccgcctgctgagtccagcatgttcggggcactttccccccttcttggtgatggtgcgctgaggcccacccgcagtagctgaccgtgttggtcttgaccgtgttggtcttcagagtcctttggtgtttattgagtgcccttgggcagatgcgggaacaggtgcttctgcgcgtggttcagatggaaccgctatagtctgcagataactgagcacgaagctgagggtggtcagacgcctattagtcgcaaaatttgctgacccaatgtgagagtcgggaatgaacaatgccttttactgacctaggaggtgttacaatgacaagaagaagtcagagtgggcaggaggcactaggccaggagaggagagagttgggaggaggaagtggccatgctgcaggtgccctaacagatccagggaagcatggagagcacagcgcgacccgtgtggagagggcatcactagcctgcctcgggctgcagggggcggggagcacatgcggcgtgcagacctttccttaggtttgtgctgggtgctctgctctcaggcccacagaattctgcactgtgagcagcgcaggtcggaagaggcatttggaaatgacacgctctgtccaggaactgcagtaaacgttctagctgttaatattcttccttctggcagatggtgggtttcacactgagttaagtagcttcacgactgctagtggctggaagcttccagattagtagtttaagccagaaaacaatgttgatacgtcttgagatgtgtataaatcatttgatttggctgggcagggtggctcacacctgtaatcccagcattttgggaggctgaggtgggcagattatttgaagtcatagttcgagaccagcctggccaacatggtgaaaccccatctctactaaaaatagaaaaattagccgggcatgatggcgcacgcctgtaattccggctactcaggaggctgaggcatgagaatcgcttgaacccaggaggtggaggttgcagtgagctgagattgcactgctgcactccagcctgggcgacagagcgagattctgtctcaaaaaaaaaaaaaagtttaaggtgttggttgtgtgtgtgtgtgtgtgtgtgtgtgtgtgtgtgttaagagagccattgtaggctacatgcatgtggtaatagactttaaagggtaaatggaaaatggtagcttacaactgacatttagccaattgaaaagtgtaggccagggtgtagatagcacattcccctgcagtgcctgctgggtcctggaacgaggccttccagcaagtcggttctcacgtcaagggcatgtcctgagggttatggggccttggccatcagggagagaataaggttttctcattttcgacttcaactaatggtcatagagttgcttttcttttcatttattggtttactgtcctttcctcatcctcctctatctctgcgtcctcctttatctccagctcttctcctcctcctctttctcttcctccttctccttctccttccctccttgcatttgttcatctttaccacattcattatacacccagcaaaatgtgaaacctttcatttcctgttcctggtacatgcagcaaaagcttgattatacaacattatgatgatatagacagaaaacacgtctgaattgtgttcatggaatatgtagcattcccatggttgtcaattactgtagctcattacggtgagcaagtatgtcttgttagtaagaaggttcagggagttgagatgacggggctgagatgctgcctgctgtctccatggtatgggcaggtaatggtgcagggggcgtttatgaactggtgtggaggtgcctaatagggaccctgtgcttgaggaaagggcagaaggctgatggcctcgtggctgtactcccgggtgcttcttgctgggcggctctcactgagtgggagtgaatgggaagggaaacttcctgatgtgatccttcagctgaacctagggatgatctccacgacagtagaccctgaggagcaccccgtgccacccaccaggagaagcccagaggaagtgataccctccctgacttgttagagtgcttctcttgaaggaaagaaaacccagaaagttctttttgacttctgtcgtactgaaggtatcatcatcttagacaccaatttagcatgaagggaagataatgtgtcagacacttgaatattgttgcacgtctgcttttccaactgaattttcgagtgcagatatatgtgcagtctgtttaatataatgggttttcgatcttgtcctttcttggaaagtaaaatgctttttattacctggaaactaatttcaagcaatagattgcatttttcctgggagtcttgtggtcagttttgtttttccaatgcagattgcctccaaatctttattttgaaaacttttcacacaattggaagacctgaaagaatggtaccatgaacacctcacactcaccactttgacacaaggcttgtttgcattttgtcgtatttgctctttctgtcacacttttgtttgtttttgaatcatttgaaagtaagtagcacatgttattattattattattattatttgagatggagtcgcactttgttgcccacgctagagtgccgtgatgcgatctttgctcaccgaaacctctgcttcctgagttcaagtgattctcctgcctcagcctcctgagtagctgggattataggcacgcaccaccacacccaactaattttttatttgtacttctagtagagagggggtttcaccatgttggccaggctggtcttgaactcctgacctaaagtgatttgcccaactcggcttcccaaagtgttggggttacaggcgtgagcaggagtgagccaccatgcctggctagtgattttcttcctgaatactcctgcacacatctcataagaattcaaacatcattcacccgtctaaccataataccaatatcactcctaagaaaattgaccatacttccacaatattatctaaatagttcgtctatattgaaatttcttcagctgtttcaataacatcttttatagctgtttttttttttttaaaaaaaacaaaatctactcattatgtttgtttctttagtcttttctaaatgcagaggtttttccccccctgtaaatgacacagacttcttgtggaagggtcctgctgcttgtgttggagaatgtcccacttaggttttgctgagtgtttcctcatggcatcatttcacttgtcttttcattccctgcatttcctgcaaactggaagttcaatctagaggtttgattgtatccacattaagtctttttggcaagaacgcttcataagtgttgttgatgacttcacattgcattacaccaggaagtgatcagtctttaacttagaagatttgctctcactctaaaataggatagttttaaaaataggcatcttttttaagggaagtgttctcactctttcacccaggctagagtacaatggtatcatcatagctcactgtaacctctaactcttgggctcgagtgatcttcacaccttaccctcccacgtagctgggactacaggtgtgcaccactatgcctggctaattaaaaaatttttttgtagagacagggtcttgctgtgttgcccaggctggtcttgaacttttgagctcaacagatcctcccacctagacctcccaaagtgctaggattgcaggtgtgagccactgttgggcctaatatatgaatcttaatgtttactctgtcttcacacataactgattgtctagttattaaattctgtgttgtaaatctgacttgcttagcttccagtgtcgaattatctgaagccattctgattttcagcctttgctttgtggctcatttgttctctgaagcctgtgtcttatgtacaaagaaaggtgtaaatactcttcttcgacttttaattgaaactgatttggaaatcatttgtcacaacctgggcaacatagcgagatcttgtctctacaaaaaatacaaaaaaactagcttggtgtggtggcacccacttgtggtcctagctacttgggaggctgaggtgggggcatcacctgagcccaggaggttgaggctgcagtgaaccgtgatcacgccactgcactccagcctgggaggcagaatgagactttgtctcaaaaacaaacaaacaaaacttttgtcaaagatgtaaggccataatgtggatggaaattttaaggggaaagtaaaatatataagcgtgtatgtatagttataaaaagaacctaaagcatctcaaagtccatagtccgtcagcatcagcgtctgtccacagagccagggtccccccttggatgcatctcctgtaagatgaaggcccccctgccctggtgtgatgtgtggccttcagtgatcatcatcatcctgtccgagagtcctgctggctctgcttggagaacctggccactttcctgcctctgctcctggcagcctccgtggcccgtcacttcttgtttgcctgtgaattctctctccagactcgagtgacactttgccttgcaaagctttccccagtgctgtcagacagggttagttctaagtctttcctgggagatctgtggcactctgggcatttctggaaggaaacttatgtgtgtctcttgtccctggaagggacagggcacatcttgttcatcagggcaccgcagccccaggacctgactctgatgccacaagcatttaatgaagacgttcaaagtgaacattcagaatctctgtctcttcatacttcttttcttgtgcttatatttagtatgtagtaacattcatatatggacactttcaagaactaacaggacacaggtgctgtctatggttgaatgacgctgtgttggactcgggctgggctgtgtgttgtgtggacacaggtgctctctatggttgaatgaagtggtgttggactcgggctgggccgcgtgttgtgtggacacaggtgctctctgttgttgaatgaagtggtgttggactcgggctgggccgcgtgttgtgtggacacaggtgctctctatggttgaatgaagtggtgttggactcgggctgggccacgtgttgtgtggacacaggtgctctctgttgttgaatgaagcggtgttgagactcgggctgggccgcgtgttctggataagtggctgtggagcacgatgaagcgtctatcgcagcatcatctctgcacccagatgtggccgtgctgagtggattcctgccccagatcttgggaagaaggttggctttcctcctggtgttggtggaaggcctccccggcgacactgctgcactccactggggcctttcattgtcctgtcccttcctgacaaggaaatggctggacactctcttcatgtcagcacccctaggtgctgggggctcaaagataagccaggcctggaagacccacccagagccaggggagcccacccccaatacacatactcaccaagccacatgctgcggttgggggtcccagaggtgtgctcaggccagcctgtggggacagcaaagtggcctccccgagaagggggcctgtcctcagtgtttcagaggcctcaccttgtctcatgcttgaaatatttcctgaagaatgccatttttgaaatttattttctaaagaaaaaaaatccaaatattgaaaggctctgcttgaatttttgtcaacaattactatatcaagaaaatatttctgatttaggtggctccttcagaatatctgattcctgtgttggcttctgcgttgcctttgcaggcctgtgtctgtaggtgaggttttcctgttcagatggagctctgtggtggtaaatgtggccttccttgttttatgttacgtgtttctctcaacttcatgagatcagaccagatagagaatgttaaagaaaaaatatttcgggcaattagaattgcaagaatgtcaagaagaaatatgtgtagtgaatagcaggctgtagaaaccatctcactgctcagatcttaaaatctgtagccaagagaggctttgaagcacccagggaagatgcatgtgccactctgcattttgtaaaattctgaaccatggactttattgtagtgctcgctttgccgacagctgctttagtcgtcgataatccccaaggatacttgcgtgtgctgttgccttcgtcaccaggacttggaggaaactgcagtgttgctatttgttatttcacgttgatatttccttccacctttggccttgtcctgcggtaattcctcatttaggattcctttgaatagttgggtcatggggagagttctgacgttattttactaaggtgaggtttgctaagccatcattcttacgtagatggcagaaaaagccattcggagaaaatatctgagtctgttcccgccaggttaaatagaaaggggatttgccaaggatctccagaagacccgagagccggtccctgacgttatggtaggcttcaagggggcttctgtagctgctgagcaactgagacagtggaggagtcctagaagacctgccaccgcctcctgaagagccaggtgcctctgccacacagctcacagggtgctcacctccctgtggaacgggggcctcgagtctcagggtctagaattggatcttgtaggtgcatctgatcataggaacccaggtcacatgctggccccttagctgcaggagtcaggacacagtctttttttccccaccttagtaagctatgaaccgtagcataagaaattgtcaaatatatggaaggtgttaagaagattatggggaactacagatggcagatgtctgccgtggttccccatggggcatcttaatggacggcttattactaggttttcagctgtgcaagacctttgattcacccatgcctttcatctctgatacccacttagcagcacatgctgttacctattctctttgaaattgagatttctttcttccttgtcccattccactcttgccacacctagctcaggccttcttattccaccgtgacagcttcctggctaatttcccttcctccattctttttcttcccaagtaaatgttagcccttgtcattaatgttagacgtcatcttcctgaaaatatccatttagccaggtttatgccgtggcagctgcagtggggcccggaggcctttcttccaggcctctgttattggaatccacctcccgcgtctatttggagctatggggcctttggaacggcttcatgagatgcgttggcccaagcagaaggctggtacagaagcagaacaaagctctgagcattctgagagttttctgttgagaaatgccatgggcttatgtcttcagcctgcctgggagccctgcatatttttacttgccttggggttgatttgatgaagcctgtaccatgggtaacatattgctggataatgaagagtggaaggaaaattagccctgaatgaatgactcagtcccatgataatgtggctaattttaatttgcatcaggaatagtaaagctgtggcccagtgtgttatcaaataaatctctaaacagccttgaaatcaatccatttattgaaaattgaaaatctttttttttttttttttttttgagacggagtctcactctgttgcccaggctggagtgcagtggcacgatctcagcccactgcaacctctgcctcccaggttcaagcaattctgcctcagtctcccgagtagctgggattatgggtgcacaccaccacgcctggctaatttttgtgtttttagtagagatggggtttcaccatattcgccaggctggtctcgaactcctgacctcgtgatctgcctgcttcggcctcccgacgtgcagggattataggcatgagccaccgcacccggcctgaaagttgaaaatcttgttccatgaaataaattttagaaaattagccagacatggtggcgcatgcctgtagtctgagctactcgggaggttgagatgggaggatccgtttgagccctattgaagcaataggcttcactttgtatcttgaactgggaaggagtggagaaaaaaaaaatattagagccctttgctatacttactttacgaagaccaattatttgttggtttttaaggaccagagttcccaggagtaagtgaaacacgactcgatctcttaagtgtgcccaatactgccagcacaacattcctcacaccggtccagcttgctagttaccttggatactcgcccaagcttcagctgactgcgcaggttattttctatatcttcagggtataaaaacagttgtatagacatacatgcacaaccatgaaaaaaatttttgactattgtggtaaagtcatttttatccccacttctgcccccccatgcttatagaaataacatgtttatggtagatggaaagtgcatacacagaagggccaggtacaaagaagaaaagaagaatcatccacgttcctctgaagaggtcagaatcactcatgacatcttgtgttttcatttggtacgaccttatatttggaatcacagttgtgggtacagttttgtaccctcctcttttcagttatgtttgagcatgtcctgtgccatttaatattctttgagaacatattttttaaacagctctactgagatacaattcacataccccagagttcacccatttaccaacagagttcaccaacagttgcaatctgaaagtatgtttttgtaaaggacatatactattttatcatgtaacactgtttaatatacgccatttaattatgcccttcaacgtggaattttaggcttccataggatacagtttatcgtatttagattttatgctgttgaatgacttggaattaatttgtaagtgtagagaaaaatgaatcctagggctcagagcactgcagcagatcacgtatttttgctctgtgacaaagtatttttattttcactttttctttttttgttaatttcaccccataaggtgtttcgggtagaggcaaatcccacaagtatccttggggattatcgacgactaaagaacagcaaagaaatggttcctagctcctcacgcagtccttggtgggcggtgggctgactggctgcgcacgctaggcctcaaggtagaagcggttcatttagagacccccaggcatagtcgcatggcttcacacacccgcaccagggctgaccatttgtttttggaggaaccacaaaaggattcagtatggaattccttaagaagggagtttctttagtttgcttaaaatagttacaactttttttttttaagacggggtcttgctctgtcacccagggtggagtgcagtggtgtgatctcggctcactgtaacctccgcctcccgggttcaagcagttctcccacctcagcctcccgagtagctgggaccataagtgcgtgccaccacagccggctaatttatttatttttatattttgtagagacagggtttcaccacgttggccagagtgatctcaaactcctgacctcaggtgatccgccaggcttggcctcccaaagtgctgggatgacaggcgtgagccaccatgcctggccaaaacagttgcagtttctataataaactttttttcccccagaataaaactagcacctttaaagtgagctataacgattccttttatgaaacttattttgtatgcagttcttattttgactttcagaaatctaaatttctcaagggtctgtgatgttggaactaaactcataccaagtcccttgtgcagtttgcgtggtgcaggaaggggtgagccaagtgaggactgtagcactcacgtgtgcgaaggtcgccgtgggcgaggcctcctcatccctgaggccgaaattttcctcttctcgtttccttttgatcaggatgttctacaggggtggaggcagattttaaaagcagtgatacatagacagaatttggcctaaaaaaagagtagtacttaaatctaaatgaggcctctggctcaaggtaacgagctgagctcatagattcaagcacctctcccctcattcccaattcccattgaaatgaacaaaggaatataaaaatagagagtctcccaagctaacacagttgctgctggtgatgatgatcttgttttggactgcaggttttggttgcagaaattcagttggatgtgcttcctgcgggtttggtgctcactttgtagcagtgcttggggatggaagtgaggggcaaactggcttttccttctcttggacaacttggttacccgcctccccttccctgcgaggtatatctactctctttgctatgtgttctagtttctgactctctttataaattatgcatttgtgtagcttcggctttgctccgagtttctgcttgatgctgtgaatcctaatgagcgctcccgggaattgggtggctctgccttcagacaaaccaggggatagtgaatgttgtgacctgtgtggccagccccagtcttgctttgtgtttattttccacaactctcagttgttgatgttgggaggataagtgtgagccacactctcagtgtgggggacagaaggcagtgattgggctgctgaacatgtttaatttcttcattctgcatggtgacttaggtgtcactgcacgtcagcctgtgaatttatacccaagcttgtttgtgccacctgatcacctgtatctttttaaatatatatgattttatccaatcagttatgaaggaagactctagtaaggaaatcccttgtgatttgctttgaattctttgggaggtgacaggcgttaataggtttttcacctgtgaggtgacatgctctgagcttacaggccttcgagtggaggtgatctggtctgcaggccctgtgtgcaattctgaaacccagaagctctgaacgctggattatttccacagctcatttggtggcaacgcttggcctgagctggggtgagactggacactcttgattgattccatggagagtggaaatgttaacgtggtgagtgttgggtgctgctccaaaccctcctgggtgtgttaaccctcctgggtgtgttatgtgagatggggcagagggatcacattatcctttcaccaagctgaacactgtggaatttcaaaaccaagctggcaccaaaggagcatcaagaacactgcccaggctgttataataacatcaggaccccactgcttgacggcccccagcctctcccacctggaatccaaagtgccgtggagatctttgagccggggcacaggatccttaggcgtgtgctccagcctttagtgggtgcctccaggatggctgggaagaccagtcatgagtcagaacttcagaatctgaaaaatccttagcacctgagaggtcatctgtctccaccccctcactttaaggatgaggaaactgttcaggagggattgaaatttaccgtcatgtccaaggccatgcattgttagtgagcatttatagttttatagtttctcaaaatgatactcttttcaaattcaaaattaacctatggggatataacgatgtcatcttaaattacattgcattggaggaaaatgtcttaaagtcaaaaaacttatgtaatattatgcagtttttggcacattaaatttgatagcccttacattttaaacattctgtaactgttattaaaaaacattaatcaagagtttttgaaacgaggttgccatagaaatgaaaatacaatgccaaaaagacattttaggtatagctaagaatttaaaaacttactaaatttgaggccaggtgtggtggctcacacctataatcccagcactttgggaggcggatgctgccagatcacccgaggtcaggagttcaagaccagcctggccaacatggcgaaaccccatctctactaaaaatacaaaaagttagctgggcatgctggtaggcgcctgtaatcccagctacttgggaggctgaggcaggagaatcgctagaacccaggaggtggaggttgcggtgagccgagatcgtgccactgcacgtgatcgtggtcaacagagcaagagtctgtttcaaaaaacaaaacaaaaaacttaccaaatttgaaattaggctcacagtgttaaaatctgcagaggagcaagacgtattttttttggcttaaggatatgtgatagtactgtcttttgcccagttttggagttaaattggtagctagatattagagctaacacgttgttctagttcatgtgtgagtgtattcgcgaggtgcttttcttgttttctttaaaagtataatgcaggatgtagggttaggtgtgtattgtataaacaagatgaatgaaattaatttatttcttgtcttcattcttgtctttgtatagtgtagctactttcacacattccagctgagggccatgccttcctattgctggcctgtaaagaagtcagaaatggtctctctaggtagcatttggtgagtcaggaagaccacacttgctgacaggcacagtgaggtgaggcccctagccatcccatgggactaaaggatgattcttgggcttctattaatacttttgtgtaagggactcagagatcttcagagatacttttataattaactagagctactcatttgactgagaatgttaaattttaaaaatttaattagctgcatttgtagaggtggagggaatatgacttgtctaaaatgacagccgaggtagcagaaataggaatcagtcagaggtgttgggaatgccgtatcaccgccctgtgtcggcctctgccgcctccccagccccgagacgcagaggaggaagcagacccagcagccgcagagcctcttcacccagcgagcttgccctagtcctggctgccccacttgctcgctccctggacttgcagccgccccttactccctggattcctcgctgggaggggaacgccaccacctagttcatgtccctgtggtgaaggatgaagtggactgtgcgtctacactgcacggctcagggaataagcactagcacagggagtcaccattgatccgaagtgctgggactgagtcccaaacctggctgtgaatttcccgggggcaagaaagaacagggttgtgtgggaagttactgagcatacatcagcccagaaaaacagctctgcccaccttttcctggggcgcacggagcatgtggataaacggggagaaagcactgccagacaagccccagggcagcggcggtggcacttggccacgggagcagcaggtgggtgtctcagattcggcccgttaatgctgtttcttccacgggcttttgctagaggagcctaacatcagtttaaggcctattctctttgcagattagggacaagataagaagccagtggggaaccagttaagctgtggggaagcacaaggtctattagaaggcttcccttcccacagagggaccctgcagatgactgtaggcaaagccagcctcttcctttaggaagcaacttggaacttgcgccagggtttgaatcaatccctctccatattacagggcatgaaaggaacacccttgatttaaaagtgttgtgaggcaggtgttaacagctgttcaccatggccacaggaagaccacagaaacgtttccaggaaatgtctagttttaagcagtttatcctcaaaggctgagtttgctatacaataattgggatttgggattatggatactgatcacttaaatattggaggatgactaattaaatacagtgacttttgttgttctgatttttagtgctttctcctgataatagatgaaggggccatttgtctcttacgcttcataatggaggcttctgttacatgtctgtgggaagacattcttctcctagtatatccacggaggcagagatgcagttcctttagaaagtgatattattggctgggtgcagtggcgcatgcctgtaatcccagcactttgggaggccctgggctggtggatcgcttgaactcaggagttggagaccatcctgggcaacatgacaaacctcatctctaccaaaaatacaaataaaattagctgggtgtggtggcacaccctgtggtcccagctactctggaggctgaggtgggaggatcgcttgagcccaggaggtggaggttgcagtgagccaagattatgtcgctgcactccggcatgggtgacagagtgagaccccacctcaaaaatgaaacaaaacaaaaaaagaaagtgatataattaataaatttttttaactgttaagagaggaggcactaaaatgcttcctttttcctatacaactttaaattctgttttgaatagagaatcttatctcgatgtgataaagattgtacttaaaatcagtcgccagcatcattctgaacaatgaaacatttatgtctcatgaaaatcaactgcaaagatctccactgtcatcattttgttattattagtgttattttagaagttctggtcaatacgctaagatctaaaaccgaaacaggaggaatgatctattggaaagaatgagacagacttattattcttagataatatagctgtatactttcaaaacctgaaaagaatcaccaaaaagcaattacatttaactaagaatttagtaaaggaactaaccatttttcttatatatcagcaattatcaataagaaactgttatggggaaatacatatatttccctgaaacactcatgaaatatctggaaatcttaaaattaaaaattaaaaatacttttattggtgataattttttacattcatataatcaaatcagagtaattgagatacctatcaccttaaatatttatcgttttcttttttctttttattttttttgagatggagtcttgctctattgcccaggttggagtgcagtggtaccgtctcggctcactgcaaactctgcctcccaggttcaagtgattctcctgtctcagcctccggagtagctaggattacaggtgcacaccaccacgcctggctaatttttatatttttagtagagacgaggtttcaccatgttggccaggctgatcttgaactcctgatgtcaggtgatctgcccgccttggcctcccaaagtgctgggattacaggggtgagccaccgtgcccagcctatcttttctttatgctaggaacattcgaattattttctttaggtatttaaaaaatgatttattcatttatttatttttagagatggggtcttgctgtgttgcctaggccggagtgcagtggctgttggcaggcacagtcatttcacactgtaccctcaaactcctgggctcaagtggtgctcctgcctcagcctcctgagtagctgggaccgcaggtgtgcaccaccacacacttctagctgcttgaaatgtactctcaattaaattaatgttaaccgtactgtcaattaaattaatgttaactgtcatcgctccactgatttatggaacaccaggtcttaggaataatcctaataagaaaggcacaggacttactcgtgaagaaaactataaaaatgttactgagaacagttaaaggtacatttgaataaatggagaaccatattatgttctgtatagaaaaatagaatattatgaggatgttacttcttaacgttaagttaaaattaaacttcattgcaattttagttcagtgcaattttaataaaaatcccaatgggattaaaagattgaagaactgattaatttgaaaaagataagtgaatataaatagctaagtaaaattaaaatttgagggtgaaaaatgacccttccaagtattatgaaatataaagataaattagttaaattaatgtagtactagtagaagtattggttgataggttaatgggatgaatttgattacccagaaatagaattttgtctctgtgagaattaatacatatatctgtgcacacctgtgagtttggggcagattatttaacagggattgacacaactggctagttttatgagaaaaaattaatctttatcttgtatcatataccagaataacatccagacggcttaaagggtcaatgtaaaacagaaacactgtaccaaaatacatgtcttccctcactcagcaggtagttagcacctggtccaggccagggttttgttcaaatgagtggacttgagtctctagcccactgaggagcatccatgggccggagctctgccgggaggaaaggacaggtgtgatcgcagcgttccccagctggctccaccccgatggggagtgtggaaggtgtgttgaggggtatccagagaaggcctccccaagaaattgatctttaaactgagatctgaagagagagtcagagccggccaggtgacccgggggaggggaactcccagcagagggaactgtggatttgagggccgagaggtgagtgtggccaggccgcagtgtaagtacgaggaatgagtagtgagtagatggtccacggagagtgaacaacgcaggcagtgaaggcactctaggagaaccaggcagcatcactgatgtgaacgaatgtaaactaaatcaatacgacagcttttctcattaaatgattgatggttttaaataacaagaattttacatctggtttaatatctggtgggagtgtaaatttgtgtaattttttttgcaaaggaatttggcagaatgtattgagtgcgttaaaatgtttatatcttttgatcaaataattccatttctggagatttatcataaggaagcctgagaatagcccttcctgccacgtccctctcaccacctgtcccctttgctgtgaaaccctgccttcaaagaagggcgttactcctgcactagggctggggtagccaggtgacaggcggaggactggctggagggcaggtgggtagggaaggggctcaatgttctgggggacattttaaaagctggaaaaacacataaacgagttccatattgaaatatttatttatttttttctgttgtgttttcagatgaagacagtcagtgttgccttagttttgtgcctgaatgttggtgtggaccctcccgatgtggtgaagaccacgccctgtgcacgcttggaatgctggatcggtgagtatgcctccctcacgcgctgccacaaaggccgtctggccggctctggcctgggcggggctcgccaagcctgtggtctggtccaggggcccgtctccagctgtgcaaatctgaggggtttttctttctggagtcacatcacctttgagtaatttccgatgcgctcacctgtgattggtagtggagagagtgtttccagaaaaatcaatacagtgatgattattggcttatataattttctactttatttttttatttattattattatttttttgagacagagtcttcctctgtcaccaggctggagtgcagtggcatgatcttggctcacagtaacctctgcctcctgggttcaagccattctcatggctcagcctccttagtagctgggactacaggcacccgccaacacacccagctaattgttgtatttttagtagagatggggtttcaccatgttcgccaggatggtctcgatctcctgacctcgtgatccgcccacctcagcctcccaaagtactgggattacaggccaattttctactttattacacgcccggccaattttctactttatatttgttctgtctggcacacatagtatctatgtacacttaaaaaaaaaatggaatgactgatacctgcatggaaatgtagaagaggtaaatggaaccacttccagcaaagcatcacataatggatcatggcccataataataatggccatcatttgctgaatgcttgtagtgtgtcagacgccactggaagcactttacaatgctcacaacaaccttgtgtggtagggtttttgctaatctccatttgagagctgaggaacatgagacatagagattagtaatttgctcacggttgtcctgtagagctggaatttgaacctatgcagttcaagtccagagactgttttttttttttttttaattgtggtaaaacatagacaacacaaaataccattctaggaattattattattattattattattattattattatttttcattctaggaattattaagtgtacaattgaacgacatgaaataattcataatgttgtgcaagcatcctcactgtccatctctagaaccttttcaccatcccaaacagaaactctgtctccattacacaactcctcattcctgccttcccctagcccctagtaaccgccattccaccatctgtctctatgaatttgtcattctagggacctcatatcagtagactgatatttgtccctttgtttctgccttctttcacttagcataatgcccccaaagttcatccatgtcgtagcatgtgtcagaatttcattctcctgccgcagcctcgcaataactggacttataggcacctgccaccacgcccaggcaatttttgtatttttagtagagatggggtttcaccattttggccaggctggtctcaaactcctgaccttaggtgatccacccgccttggcctcccaaagtgctgggattacaggcgtgagacaccatgcccggccaagatacaatttatatacagtaaagttcacattttttagctgtacatttctttaagttttgacaaatatgtacagccatgtaacaaatgccataatcaatgtatagaatatttctgtcacaccaaggaagttcccttgggtccctttgtaatcgatcccctctcatttctctggcctctggaaaccattgatctgattttttccttttacagaatgtcatttaagtggcgacatatagtttgtagtttttgtatcttgcttctttcctttagcagaatttatttgtgattcatctgtgtagctacgtgcattagtagtttttttcctttattccatttttatggctccctcacaatttgtttatccatttactagttgacagacatttgggttgtttctagtttttggcaattatgaataaaattgctataagcacttgatctttgtgtggacatattttctctggttaatatttaggactgtgattattagctcatatgttaagcgtatgtttaaattttttttttttttttttgagatggagttttgctcttgttgcccaggctgggagtgcaatggcacgatcttggctcaccacaacctctgcctcccgggttcaagcgattctcctgcctcagcctcccgagtagctgggattacaagcatgcgcctccacgcctggctaattttgtatttttaatagagacaggatttctccatgttggtcaggctagtctcgaactcccgacctcaggtgatccacccacctcagcctcccaaagtgctgggattacaggcatgagccaccgtgcctggccaagtgtatgtttaattctttaaggaactgctgaactgtcggttttttaaagatctttaaaaataatgaatgtcttttatatttaccttcatatttattgttttgaggaccattcatttctttccgcagttccaagtttctatctggtatcataatcattctgcctgaagaacttactctaacatatcttgcagtgctggtctgtaggcattaaattttcctagatttctgtttggaaaattcttcattttgtctttgtggttgaaaggtattttttcggggtatgtaattttctgttgactcttttagcactgtcttttaaaacagtcacctgttgtgttctggctagcagtttctgagaagtctgctgtaattctttgtttctctgtatattttgcttcatttttctctggcaatcttcaagatgttccctttatattctcagtagctttatctataacctattagttttttgtttgtttgttttggaatttattctccccacccttttttttttcttttagagatgggtgtctctcaatgttgcccaggctgggctatacttgaacatctgggctctagtggtcctcttgcctcagcctcctgagtagctgggactatggatgcccagtactgcacctgtgaaatttattctttttgggtttctgtgagcttcttggatgtgtagtttgatgtcttcatttttgaaaagttcccattatcttttcaaatatttattgtttgttttctctctcttctgggactcagctctctatgtattgtgctgttagacattgtaccgcagctcttccatgtgtctctctcttctgggactcagctgtctatgtattctgctgttggacattgtaccgcagctcttctgtgtgtctctctcttctgggactcagctctctatgtattgtgctgttggacattgtaccgcagctcttttgtgtgtctctatcttctgggactcagctctctatgtattgtgctgttggacattgtaccgcagctcttccgtgtgtctctgtcttctgggactcagctgtctatgtattgcgctgtcggacatagtaccacagctcttccatgtgtctctgtcttctgggactcagctctctatgtattgtgctgttggacattgtaccgcggctcttccgtgtgtctctctctcctgggactcagctctctatgtattgtgtcgttggacattgtactgcagctcttccgtgtgtttctctcttctgggactcagctctctatgtattgcactgttggacattgtaccgcagctcttctgtgtgtctctctcttctgggactcagctctctatgtattgcgctgttggacattgtaccacaactcttctgtgtgtctctctcttctgggactcagctctctatgtattgtgttgttggacattgtactgcagctcttccatgtgtttctctcttctgggactcagctctctatgtattgcgttgttggacattgtaccgcagctcttccgtgtgtctctctctcctgggactcagctctctatgtattgtgttgttggacattgtaccgcagctcttccatgtgtctctctcttctgggactcagctgtctatgtattgtgttgttggacattgtaccgcagctcttccattgtgtctctctcttctgggactcagctctctatgttttgtgctgttggacattgtaccacagctcttccgtgtgtctgtctcttctgggactcagctctctatgtattgcgctgttggacattgtactgcagctcctccgtttgttctctcccatgtcacaatgagcttttgttagtctgctgataaaccagccaaggaaattctttttctctgatattgggttttttatttctagcatttccattgactattttagtttccatctctaggggaaatgcatattgcctgcctttccttctagagcctctgctgtgttcatcatagttaccttagagtccttgatctatagttcagaaaacagggtcagccctgagtctgagtctcctaattcctttatcatctcttgactgtaatttgcttttccttgctttttttgtgctttataaattttaattgcatgctggacattgtgtgtagaagaacaatagcgaatgaggtaagttgcatagtctatagtttagtaagtagttaactggggttagaatttgttgttgtaatggttatacccactgcaacagcactcttagttcttagagtgattagttggtgcttgtgtcagtcaaggttctccagagaaacaggggcagtagatgtgtgcctgcatgtgtgtataagtatgtatgtatgtatgcatgcatgtcttgtgatcttgaggcagaaatttcttctttctcaggaaaacctcagtttggctgttaaggccttcaactcattggatgaggcccccatattaccaaagaaaatctcctttactttaagttagctgattgtggatgtcaccacatgtatagagtactttcactgtggcacctgggtttgtgtttgattgaattgctgagtgctacggcctggcccagtggacacataaagctgaccagcacagtcctcgtgcattagggtgggtacaggcaggccagggggttttcccagggctcctgctccacccctagcctgagctgtgcctgcccacgtgcctcactgagtggtccctggctttgcctgtctcctggcacaggatttccattgctagttactcagcgccaggctgtggagtggtgggagttctctgtggtcctggtctctctttagtcttaggcaggccctgggcatctgggccttgggcgtagtgcggttgcagtgttttcacctgtcccccagtgatggcaaacgtctgcctcgattcagtgtagaattctgtgcccagggcgtgttctgctcctatcccaggagtaggctgttttgcaccttccctcaccccatcctccatgctcttcacctgtgtcttgggacagtgtgttctatgcccatggtgagcaaggtaggttttgtctgtacctcctcccactccccaggtacaggaatgtgtgcctgttcttgtggactgagggtctcctgctttgcttcctaggggaggaggtctctgggggcaggtggacttcaagcctctccacactctgtgctgcctccagcagatgcttctcatgaagtgggggtgcagtgggggtgcatgcaggagagtgtgagtgccccttgtgcctggaccccctgtgtttccacacggatatgcaagcgcacactggggcctcgaggacacattaccatcttagctggtttcttgtgcagacctgcgctcttcaaagatgggctgtgcatgtgcccgggctttctcggagaggacgggcctgtgggattcggtttgtctgccctgcggtctcagctcccttatgagctcaagaaaagtgatgatgtcagtgattattcagctttctcatgttgataggattggagccactctttccccccagctttctacatcctaagcaaaagcagaagttccctttattgctttaacaaaaactacaaattattctcagcctgggcagcatagtaagagaccatgtctctacaacaaatcagaaaattaggagggcagggtggctgattttgagatgacaggcatgcctgtagtcccagctactctggaggctgcagcaggaggattgcttgagcttgggaggtcgaggctgcaatgagctatgattgtgccagtgcattccagcctgggcaacagagtgagaccctgtctcaaaaaaccccaaattcttctcatctaaatctcatctaatctgaattggaaataaatgttgtttttcctgcattatttggctgtcacactatgtgagggtgttttaggatgacagttccctcaccccttccaggctgcttgtcccccacaccccatgatggagcagctgtgttttgtggctgatttcttcagatgctctcttggctcactgctggctcccggtgactgtgctggttgaaattgacttcttattagccaccatggactctttccacttcatccgtccctcgtcacagctgaatgtaatcagttattttctcttcctctacagcaatgcttatgttaggcttttcgaacaagccttcctcatgcggatccctgtgtgtgctccggggacgggacgcgcaggcccttcggggttgtgtaggtgtcatctgaggatccagttgctcttccctgcctgaggagcctgagcttttatcagagctcaccgccctctcccacacagtctctttgatcagtatttacacaatgttaatgagaatggaaaaactccatgcttctttcttggtgtgaaagatccagcaaatgagatttctaaaacttgagttttaaaagttttcctgcagtttaggaatatcgtctactttctaataatttcaagtgaattttgagtttaggagggcatgtgctttttctaagttggaaaaattttatttggcctttattaaaaaatgggtaggttcctggtcctggtgatggtggttttaacaatatggcataagagaataagaagcctagtgatttgaatcagcacatttgcaggagtgtgtagcagcccacttttattttttagtttatttacttgaaaatttttatttttgtgagataagaccttactctgttgcccaggctggagtgcagtggcgtgatcatagctcactgcagcctcaaactcctgggctcaagccatcctcctccctcagcttcctcagtagctgggactgtagatgtgcatcccccacgcttttaaaattttttatggagacagggtctcactttgttgctcaggctggtctcgaactcctgggctcaagtgatcctcccacctcggcctcttaaagtgttgaaatgaccggcatgagctaccacactaggcccatttttcattttgaaaaaaaagttccaaaagttgcaagtatagtactaagctgtttcctttctgattctctgagagaaggcggctgacatggtgcttcagcacctctgaattccttagtgtgtaattcctgccagccgggagtttctctttccagatgacaacgcagtcaccaaaatcaaggagcattcgcgtggacgtgtgactgccacgtaagcgtccgctgcatgcaggtttgccagtgtcccaggaatgtcctttgtagcgccaggatcctgctcagccatgcgccatcctaacttcctctcactcagtctgaagcagttccacaggcattccgtgaccctcctcaccctggcgcttgaaggtggcagtctctttgttttgtagaatgtctccggtgtctcctaatgattccgtttaggtcatgcttcgctggcaggagcatcacgcagagctgcctgcttcacgcgggctgcaccaggtgatgcggggctgtgatctatccattactggtcatgcagatcttctcacctgattcagctggcgcctgctggacctcatgtgaaattcccctttgtagttgataggtattttcgggaagaagtgctttgagattgtgcaaatattcctttcctcgtgactttcaatttcttcattttgaactcatggcctccattttcattcagtggatttagaatccagtgttatcctttggtgccgagcttgtctccctctggttgttgggaacccattgggccggcttctttggcttctgtcttgtttgcatcattcgtggagcatgtgcttactttgtctcatctagtctttttcccagcctcattcctcttagtggaatgtggtgttagaaactgagatctgggtgccaggtgttctctttgaactggcgtgctattgctcccaggacctctctcgctggacagagcaaggaaatgcatgtgtgtgcatactatgtatgtgtgcatactgtgtgtgtgcatattgtgtgcgtgtgtgcatactgtgtgtgtgtgtgcatactgtgtgcgtgtgcgtactgtgtgtgtgtgcatactgtgtgtgtgcgcatactgtgtgtgcatactgtgtgtgcatactgtgtgcgtgtgtgtactgtgtgtgcgtgcatactgtatgcgtgcataccgtgtgtgtgcgtactgtgtgtgtgcgtactgtgtgtgtgcgtactgtgcgtgtgcgtactatgtgcgtgtgcgtactgtgtgcatgtgcgtactgtgtgtgcatactgtgtgtgtgcatactgtgtgcgtgtgcataccgtgtgtgtgtgcataccgtgtgtgtgtgcatactgtgtgcatactttgtgtgtgcatagtgtgtgcgtgtgcatactgtgtgtgcatactgtgtgtgtgcatactgtgtgtgtgtgcgtactgtgtgcatgtgcgtactgtgtgtgtgcatactgtgtgtgtgcatactgtgtgtgtgtgcgtactgtgtgtgtgcgtactgtgtgtgtactgtgtgcgtgtgcgtactgtgtgtgtgcatactgtatgtgcgtactgtgtgtgtgcgtactgtgtgtgcgtactgtgtgcgtgtgcgtactgtgtgtgtgcgtactgtgtgtgtgcgtactgtgtgtgtgcatactgtgtgtgtgcgtactgtgcgtgtgtgtactgtgtgcatgtgcatactgtgtgtgcatactgtgtgtgtgcatactgtgtgtgtgtgcataccgtgtgtgtgcataccgtgtgtgtgtgcatactgtgtgcatactttgtgtgtgcatagtgtgtgcgtgtgcatactgtgtgtgcataccgcgtgtgcatactatgtgcgtgtgcttctctctgtacacatttgtctcagcgtttctgtacctctctacatgtacattcatgcctcctattccacctcatgggggttttccatatttgtagctccatcttctgacagtgacaaccttggtatcctttgtccttattgtattggctaatgtggtgcctcctcctgtgtgaaccctcttctcctctctgccattgctgctcctctcagacccggttatcctttgccatttcaccccaatatctgcctttctcactgccctggtccaacacccatatggtcacctttctgcagccacacctctccttcttcctctgcacgggctcagggcccagtcagacttgagagctcattccaggccagtgtggctcccatcatcctgagacagatgccagctttgcccagacccaccttgtggctttaggattgttgaagaagggattttagcattttcaacaagtgctttaggtttcaggcctggtcagccgagggaaggatgatacaccagtaaccaagactgggacgggagctgggctggctggcagatggtggggtaccatttcgcacatggtgaggtgcttgtaggaacctccaagcggagccaccatccagtggaaagtggatctggtgggagaagagggctcattgtagactagaggacccaggggaggtcagcgcctagtacgaactagaccagagggtatcgggcagaggcagggccctgagggtgcagagaggggtgccaaagaggaggaccagggtggttctggatgagtgcgtggaggagcttctggtcagcattgtcaaggctgaggtggtgtccaggctgattgtagcaacctgaagagtgaaggcagatgaggtggtgaagcttgtggggcagcttggccaggaaggtgaggagtggggtactagtgttggggctgggctcagtgatgggtttgctctgccttcctcaagatgagaatgacgggggccatggaggaagccaaaacagggattggtgcaatcaaattacttacaaacatgttaccgtttagaaggcagacctcaggattttatatttggtcttagcattttgaggtctattactagaaatcgagatttttgtgttaatcaagactccagctttattccttccagctgtgctacacatttaactgttttgggcctcagtttcctcatctgtaaagtggagctagtgatgccgtgtacctcatggcagggtgggggaattaactgggagcagagacctggtttggtgcagagactggtcctcacctccgccgccccaactctagtccctacttctaccccaacatcacaacacctcaaacaccccgacccctacgtcacagcgcctcaagcatcccgacccctgcaacactgtcttagtctgttgttgctgctgtaacagaatacccgagactgggtaatttacaaacaacagaaatgtatttcacgcagttctggaggctgaggagtctaagataaaggcactggcaggtctgttgtctcttgagggccctgtccatcttccaagatggggctgtaacactgtgtcctgtcacggtgaaagggacagaaaagcagaagtgtgcgtctagttccctccagcccttttatgaaacacgatcgcctcctgaaggccccatctcttcatactaccacattgggcttccgttccaacacgtacatttttggggacatattcagaacatagcactagccccagtatccccactccagatcacccacacccccgcaacacgccccagtaccgccactccagatcacccacacccctccccaacacgccccagtgctgcatggggagcaggggccaaggtgctgcatgagctgcttcctgaatccgtgcctcttccgctgctttctgtagggctgactacgaaagagggctgcagtgaacacacctcactgagccccactgccgggcatgtagccttgcaggacggccgctcactcagggttgaaggtctccagcagattctgggagtagatgcacggtgctgcttatttcgttttacaaattaaacatccaatatgcaggtagcaatgtgtgtgaatccccagtgctttatgtagaaccctgagtatggggttcatttttgggcagggtggggtggagcggaaggtggtctgtgctgatgtcagaggggtctgagaagcttgaaaaataagggtaactgtgtgtgcctgaaccatgcaggaagacagcactccttccagagatgagggagagcagacgtcatgtctgtgagcaaacaaggggcccatgcccagcgtggctctgggtgtcatggcctccctgctaggtcatccggatgaagcctggggctgtggagtcagctcgtgagaaatgggatccaggtcctgagcgtgctggaactggcgagacggggtcacagcacacacctgcgtttccagccctgcccctgctgacggccaagacctcttttcccacccctgctccgcccccctctggataataagttgctgttctagttcatagaagtgacacttgtcccttttcagagaagcaggggagaggctgttttgttttatggcccgacattaaatactacaacagtaatactaaaaacaatcctgctgaagagctgcgcgtgccccactcttggggaactctgctgtggcagcagagtgcggatgagctgcatgctgagcagggagtgtcatttagcggaaatggttttgtgtgccagctaatggtagctgtgtatcagaagaggtgagaatgcaaaggtttgtcagatgtgtggaaattctgtcatcccaagggaacgtttgggaggtcttagctttgtttttctcttcttaatgcaaacacgtgagcattaagagaccttgggtagatgagctgaaaatagtcgtgatcgcccttggcggcggctcgtgggtttacagagcacttgcacagacttcgtcattgattcttgcaaccatttgggattcatagaccagtcaagttggttaacagatattgattaggtggaaacgtatatgttaagcatagtgccatatacaaggaactgtaagctgtgctcttgctttcaaggcactgatagtacacctggggaggtaagactaggatccatgcagtagaacagagaccaatacgaggtcaagcttgaacggcctggaaggccagagaatgctgcggtagagacgtcagggcaggcagtgggaggcaagagcaaagagctgaaggaagagcatgagcccacactctgaggtccgaggggctgggttttcgcacaccagctgggctccctttgggcctggggggtcagtagcacccgttagccacggccagtcacagccgtatgctctgtgcacacagctctgtgcccacagctgaaaccttggctctttggggcttatggtttaaaatgctgttttcttttcttcctttcttttttttttttttttttgagacggagtcacataggctggagtgcagtggtgtgatcatggctcactgtagcctctacctcctggactcaagcgatcctcccacctcagcctcctgagtagctggaaccacaggcatgcaccaacacgctgattaattaaaaaaaaattattgtagagacggggtctcattttgttgcccaggtttaacatactgttttctctgccagttccattggtgtctcaaggtggtatctctgcttcccctctgaaggaatctgaaagaagggggttaactgcttggagcccacctctctcctgtatctactttccaaagtgaggacagttttttaaaacaggacatgttcatcccctcatatctgctgaaaatccgtctagctcttggtttttgtataatacagcaataggcaacacaggaacgtaattttgtagctatgtgaggagtgaggcctagtgttagaacggggccagactgtaaaagatctcgctcctgtacggctcccgtcctagtcccacagacgctgcaagggccgcgggtcccggccgaagctttcctgtcccagatgcctgcagctgtgtggctccaagctttgcgcctgagctgaggaagatcacacgcctctcactgtatacaggactaattattacaaaatagacagggatggcattatggttaggaaaatatagactcattaaaaatcatttctaatttcaaagtagcccctttgctattatgtattttctcagtcaaaaatgagttgtttaaggctacacaactaatgagtggcagagtccttgaaaaccacacagagaaatttgcacttcatctagtaggcagcactcaatatgtcaattaaaaatgtttattaagtgtctgctaaatacacggtacaaagaactacaaagattgtccgagcagtgagtgctggatggggctttcagtgtgaacttttcactgaaggatagcacacagaggaaactgcacctaacccgggtgtatcctaaactgatcatacccatggaccccagatcaaggaacaagatgaccattggcccagaagtcttatcttgtcccctttgggtcccctcccccagctgcactgctgggtctccactcttggcagctttccatctaaatggagcacacagcccgcactgtgggcttctgaggggaggggtcagcctgcgctcatcttcagggtggactgagaagagaaagactaggtcattggtggccctgtctgtgcctggggcaccactctttggggccattgggccagattgaggaacccagctgggaggtgggagagtctcagtagcatcgtgaagggctgcggattgggtgaacatgttagcagtggctggtggagtgccagctctttggaaggtgaaatggataggatgggtaatcaaactgggtacataggaagaagatggagaggtttaaaaagaaaaagctgcaccccttcaggttggctgaatgccagcactatcaataaccttggagcaagtcatttgactgctttaaacttcagcttgcccttctgtcccatgaggtgggttggaccaagttcctttcagtgtaaagttctaagtatcttgaaattcagaggggttatgctgaaaatcttgcaaataggaaaatttataaagaactaaaagttttatgcaaataccatttaccatctccttttccatccacctacccatccatttcattcatcaatttacccacacactcactcgccgctgaagtttcattagttctttcccagattccccttaaataggagctcataaaggaattagaagagaaatgttttataagacacaactacagttttacatttatgatctgtccacttcaccccacatcagactgatactgttgtcaataatatctatcggggaatttaattttagtttatttaaattatacttaatcaaatgctaaatgcatcgtttcatttgacctcattctttcccgtctcttcctctgcttctcatttcagctctcccacccactgccctattcttggaagggaaccatacaattaactgaccacagggattcccagtggataggcggttatagtgccatgtagctggtcacggcctggtgagcagctgacagtggtttcacccctcctgggtgggcaggtatcctgacctgagtcagggcagggagagtggggcccctgccaggctgtctctactaacgagggccgccatgtctctgcaggatgttgtgagggatgcagggaagtggctgcctcctgccaacactggggagagggtgggatgggagaagggcctggactttccaaggggtgaaatccaaggagggggtactccttgaatgggaactccctcccttcttcctctgtccgtggttcactggagagcatgcatagtgtgagccaccgctgaccgtcgtgatgcatggacagttttctgaccatagatgacagccgcgggccgcgaccatgctggttgctgcagttaagtatgggtgactgaactcaacgccttccagccagccctgtgcgtttactttgctcctcctcatgcatgcggcaaggtcgctctttggcatctgtttgttaaagctgttttttgctttcctttgccttgtttgtgtacttcgtggcccctattttttgtttttcagatcccaatccaatcctatcttgtgggtctgatcacagcacagttgatttgggtcactatgatttttttgagaccttagaactttgttcctgagagaaatgaagaccaaacatgtaacgtctgaagtcacagattacggattataacaaatttaccacaattcttccagagaagttagatattacctggtttttaccaagcttttctcagccagaggtgtccattgaattagaaccattgaattagaatttccagaaggttagggcctggcatctctgttttgaaaagcccttgatgactttgacctatctatgggcgaaggccctttccagttgtaaaatcttattaacgtcatgatttttattttatttttttatcagagtaacatacatatagctaaaaaaataataattaaataatgccaaaaactatacaggtggctcttggagatcctgcgggtgtggctctagacgactgcaataagtgagctacatgaacgttttggtgtccagtgcatataaaagttacgtttacactgtactgtagtctgtgaagtgtgcagtagcattgtgtccaaaagaacatacacactttattttaaaaactgaaaaatgttaatgatcactggagccttagcgagttgtaatcttttagcatttaattggctgacggagggtcctgcctcatgtggatggccgccaactaatggaggaggggtggttgctgaaggtaggggtgactatgggaatttcttaaaataagacaataacaaaatttgctgcattgattggctcttgctttcacgcagcatttctctgtagcatgtggtgctgtttgatagcattttacccccaacagacagacctggagtagttggcagatgttttctggaaaatgaatgacatgagcctgtcacattaaggaaaacaactgacagtgtttgtttccactgataaaatttgagatttcaaataaaaaaaataaaatttggaaaccttgtacctaccactatgagcctggcaacttcttttttgttgttgttgttgttgtctttgagatggagtctcactctgtcgcccaggctggagtgcagtggcgtgatctcggctcactgcaacctctgcctccagggttcaagtgattctcctgtctcagcctcctgagttgctgggattacaggcgcccagctaatttttgtgttttcagaagagacggagtttcatgttgctcaggctggtctcaaactcctgaccccaggtgatccacccaccttggcctctcaaagtgctaggattacggtggtgagccaccacacctggccgagcctggcaacttcttagtacttaagacatttctgatgagctcatggtaatgttaatgagtgtggattcttaaaaaaatattggggaatgaaatatacaagatctgtatagttcaatgagctgatattttccagatgatcaatgcatgatgatacaaaataatctatgggtaaaaaatccactcaaggtgcagcaaacagcagtgaattttaatgtcatagcatacaaaaagttcgttgatgtggtttcagatactacatctcatataatctgaaggaaattaccacttgataatttttggtgtagtatcaaacaaaaagagtcatgattatgtaaaatagcattttaagatactcttctgttttctaatgatagatatatgtgtgaggtaggggtttccacatatgcagtcactgaaaccatgaaatgccacaggcgaatgcaaaaatggatgagagtcacccatccttgatcaaaccacatattccagaaattcgcaaaaatatgcaaaaatgctgctcttctactaaacttttttggaaaaaatagttatttttgtaataaatatttatgttaaaatataatgggttattgtttttaaaatgaatgaagaaaaatatttaaaaaatcttagctgaatttcacatagagtagatattgatagattcaacaacataaaccaaagctctttgaggttttcaataattttagagtgcaaaggggtcctgagaccaaacaagtttgagaactgctgatttagagttaattgccctggaacccactcctgaaataaatgggtaaatcctggacatgaatgtacatttgtgaaacggattttttttgtgggaatactgagtgcagatgaaaattaattaaaaagtatcacttctttgtctttttctctcctccttttcctgtacccatgagagccatagtttgaacaggaggaagcatatgctgtcactgcagagctgccttctcagagaaagcctgagcaggagcctgagaataaaacagtgcaagtgcgggaaagctgcaggtgccgaaatacaaatgaacgtgggtagaataacagcattcacttgcccgtgatgttaaaacactggccttcacggcgtgtcagcttgtttgagcaccttagctgttcagtaaatctggttaacactgatcaaccttaggcgttgtgttacttttagtcaaaggtgactttgaagtgtgttatataaggagaaactgtggaagagaggcctagcagaggaggaaatgcagacgtaaagaactttctcttttccattgcttcctcagatcctctgtcgatgggtcctcagaaagctctggaaaccatcggtgcaaatttacagaagcagtacgagaactggcagccaagggtaagtgtgcttcacttgctcttccctttccttcttacagggaaactccagttccttggtttccaacactctttggatccaagtgagaattctgtgcacaccctgcccttgtgtggcatggcgcctgcgcactgcgtttcgtgtgcctgcgttctgcctgctggctattggtggctgtgttgtcttgacagcgtccgcattattgtgagtcttgcattggacagtccaacttattttgcttaagtttgttccagatttttagaaaagaaaaagtattcttttcgctcttaaccatggttttaatttttctcaggaaatgtattttcgataatttttctgcaacctcaactagttaacgctattccgcgtgtcttcagttttcacatagttgagaaaaaaacacccaacagtcaaaagataacacttattatatgctttgcctttgattcaaaagataaggttctttttagggagccagttaccaattagtgtgtgggtttttttttttttttttttggcttatatcttacagttttttgtttgtttgtttaaagaaaagtggcttagaatataactgtgtcaaattgcctttaagatcttaagttacttgtaatccacccaaagacctttagcctttcttattaactggtttggagatttaataaatttaataaaaaactaagaatctgggcacttatggaagtgccctatattcagctttgcatgatagatggactcgagttacctaaaggaaataatgaagaatgcaggttgagaaggtgcgcgtctcctgcaagttttactctccccttttggatgaaagcctcatgaaaacacatgatttatggaaccttttgaacacttatttggttggaattttgatttgtggatcatttatccacatgatgtgggatttagagattccttatacattatttacattcttagagtaagagaacagccaaaaatgaattttttcctgcctttaaaaatgcccttaggtcatttctgctgttgcttccagtcatgagctaattgttaggaagcatctctgtgtcttagggtgtacctttgtgcttgcattgccaacttgtcaagtcaataacagcagacttttgttctttagaaggcagtggcttcatgggttcttgactgatgcctaatggcttgactttttcctctcttaaattggttgcctcttgatggtttgtgtacacatgctgtagcctttttcttgagggcgcagtgcgtttggggatggcatgaggactggagagagatttggatggtggagtcctgtaaaaatgtagttgagatgcctcgtgttttccatagataatagcttctttgaagactttgaaggtaccctagggtctcagcatggtgagacgggcacttgcaggagtgtggggcagagtggcagtattagaagacatggccgtgttggcacatggcatgtcgttaaccaacactatgggaattcagaggaatgcctttctggctacttctggccatctcctgggtttggctttgtacctttgcgttttactagatacctttgtttaaaaaagaatgtaacccaataaattcagatctaccaattgtgttctttctagaatgagtctctgctattaaaactagtttcttcttttccaagaattattagataaggaaatatagcctttcagaatacatgtgtttaatatttcaagatattgtatgtgtattccatttgctctgatttacaattgttttttttgagtgctaagagttgatttactgctggctttattattagtttcgcttggtagatatcagctagttgatgctagctgacaggaaatggaatcttctaaagtggcatctgttatttttaatctaaatttctgtctacgagcagatctctccatggcattgagaagcggcatcatgatgtagggaaggtgacctttacatgtaggtcagtgatgacagccagaaagatgacagtgtagactcagtacaggatggaggattccctgcccatgacagtggcacagttgtattcggacagcgagcacaggtgcaaaggggtgcagtcctctgaatgatctgtagtctgggaaaatttgttaaagttggccagatttcaagaatggatgtgcaaaataattctctgagtaagagatcgtttgaagggctggtgagatggagaatgtgttaagattacaggatgcttcggaaaaggtaccagcgcaggcgggatcccatctgggctggtttataaagtggaatctggaataaagtatccgctgcagcctagaaggaagctgttcttgcacacagagtgggatcttttgtccccattcaggaagcaaaaccacaacaatggacacctaatatttgcttttcgaatgccaacaccattgcattcattttttagtacaataaaaatgtttaaaaatttcctgctactatccatgagcgggcctcatctattttagaaattagcctaaggtaacggatgtcacaggatacctctgaccggctcccaggtgtgagcgtggggctgtgccatatgcactgggtaataatagcacttgccccggtgcgcgtggcacactgctcctcacagctttccgtgggttacaggacagagggagggaggcctggcatagatagcgtggctctcagtgtggggcagacctcatgctgccttctagagtttgcatgaaacaggaggcacttagcaaactcagatgtttgtgtgcaaggggcctggttcctgactgtaaatcagggtcctttgaaacattgcaaggctaaacacgcaccacttgattgcactctacagggctcttgagtttctgcagtaataaagagaggttgatgtgccatctgcaataaaacaatgggggcgttattaaatttcccagaccttcagtggaaagacccatatatctggttttctctttctctgtgtctttattgcaagagtggaaaaccttgggtcatttaatgaaaatgagattattttcattaaagtttgtcggagtcgttgcctccacgctggcatggatgggagcagagtaggaaatgcctgttttctcaacggtagcgtccatccaggaggtgcagaaagccaaccccggaacccccgtcggctgcaccagaatggtgtctggaagcctctgatgatttccttgctggtgctggaacgcttggacttgttcttcatttttctagcttttgatataggtgattccagttcaaaaggaattgagagaaaccatggtgattatatttttttctgaaggctgccagccactatctggcccgtatttccttgcttaggcccattgagcccttttctaaataatttatcagtttgccactgatgaaatgtttcttctgattaaatttaaggctttgccttattaccttgtaggtgtataaatttgtgttctgccagagattggaggaaaatgccgaccgttgtttcagtggaaaattctgcagtaaaacctcactcattccatcataagtctcaaatgaaagttttattgggaaatgggagtaggagattattataaagctgggaccatacagtgaagaatttatctttttagagaatttttctaacaaattggggctactggcagtttagtacaggatggaagttaggagctggagcctgtggaaaaagacaagcaggaggggcctcgctctctgtgtccttctttccccagagagagtggacaacaccagaagcagaggccacacctctttacttggggtgagctttaattcttctggtgccttaaaaataagtttctatgggaatatctatcatttactaaggaagatgaaacagcatggcggtgcctccactgaccaagtctgtccgtcgggcaggtgtgtctaggggaggaggcggaaggcgctcctcagtcatggagccacgttgttgtaggagctcattctcatcttgtccaggtctgcgagtagtgaaggcagcaagtcctgtgtggcggccgtggggcttccagggagctgagcggtcaggttgagtcagtttccatgtggtggacagttcttacttatccatgcacagccctggtttgtggattacagtgaacagattttgaatgtcagcttcccttcagttcaccgtgcttctcagatgtgtcacagttaatttgtggttaagggatgaaagttggttttgccattagataaacatgttttttatagtgcctaaccccaagcagagtatgttcaaggagagaacaaaacagctcccaagatctggtccattagcccagtagaaattgttattgcattttaatgtaaatgacagtcatcctttcgtggtattgataatagagttgtttgtgtgcttttatgagatgctttgaatgaaccgaagctgatgactatacctcctgttgggaggagggggtttggggagcaagggggttgagaaggccagtggtgggcagttttggttctacttaacaggtgtgtcttttggattttaggcacaagtgttatttgcagaactgaatgtttatgtgtaattccatgttgtttaggggtttggagtgaggataattggaatccaggcatcttctccttgtccctgaatggggctgctgcttgacctgtccacctcacagggagtgtcatgtggccatgtgtgacaaactgtgaaacccttggtattgagtgctcacactgctaggtgtggtgggaggcgcctagtcaggcagccgggttggctttggggagcactgcatggatggcttctaagatccacttgtcttctttcccctgggatgattagacaggcctctgctttgtgggcaaagcaattggtatcagcacaagtcactcgcttccttgtgccccccacccccaaatgttttggaatgaattttatagatggatgctgatatggcttggctgtgtccccacccagatctcatcttgaattgtcactcccacaattcccacgtgccatagggggaacccagtgggaggtaatcgaatcataggggcgggtctttcctgtgctgttgtccgtagtgaacaagtctcacgtccctgcacgagctctctcttgcctgccaccatccatgtaagatgtgacttgcgcctccttaccttccgccatgattgtgagaccttcacagccatgtggaactataagtctattaaacctctttcttttgtaaattgcccagtcttggttatgtctttatcagcagcatgaaaatgggctaatacagatgcagtcaagacgcataaatcagtgggttctaccttttcttaggattttcaggctcagatatggataatcggggaagaagcagctaagttgccctaggacagtactccacacctggaggtgctccaaagctattcatggaacagcccaaggtggaccgttactcgctgtgactcctgcttggggcattcacgttgcgacattagttccaaattgacagtccagttcagctggtgaaaatggccctataattgcgattggcagcatcccttggcgtgcggccctgatgccattaccattccatcatccatcccgtcttgctgtctgccctgccgccagccctccctcctcctgcccaaactcacctgactttcttctctgtgggtcctaaggttgggcttcatccaccttgagtttctgtgacaagctgccagtgaggactcatgggcaaaggcagaactgtgggtggatggctcacagcttgcataattcagtacctggtgtgaagcactttgcctgtgtactcattaaatttgcaggacggtacagacaatatcttctggtggtcttggggttaactgtggtgctttgacagtttcacttaactgcttactgcccagaaagttaagaactgttcctatgatcaatgtttttacttatatttttgccttggcctcagcagtgctctcccacttcgtcttccctcctttctagtgcttctcgcctgaaagcttttccacgtgcgtgccgtgttcagtgagaactctgattcatgctcttcagccagaagccttcgtagtcagccctgcccacgcacttcctgccttgccctgtccccagaggccatggtattggaagcagcttcctggaagcaagcttagattatgcgaagcagtttattccggactctttagaccaattgcaccagagcataaaggtgttgtcacctactgctatccctccgaataccttagtgacatgacctataaattcttttaggcacaccaaagacattacagaaagaagaatgaaagaaaggcatggttctgcagcctcctggaggatggcagcctgttgtgactagactcctcagggtttcagtccattagagctggtcccagaggggacccctgctggccagccctgtgttggactcttgctctccgaggccacctaggggattcactagagagcccatttgggattgaagagcacgcgtgttgactagagtgggttgcagcatgggccgcagcctgtttaaacactgcctagggaagattggtggagtccgcctcctcccttctgcctcgtaggtccgcagagtcgtgctgggctcaccgctccttccctttctgggcgggagcgcccctctcactggtaggggagctccctgggaaatgtggtctcctttctaccagtgcactgaggggtggggtggggagagcttaactgtggaaagaatgcgaactggtttagttctggctttgccacttcttagaaatgtaactctggacaaattactatttaaacttttaaaatttgtacatgcaaatgagagttaatggacagaataaaagtatataaagcatttgcaccagggaggccatggtggttggtcatcagatccttacttcccatccctttctgtcccttatcccttcctctccctcatggttgaggtggtggaggcccctcccagaacattctgcccaggagtcttgctgccttaagcccctccccatcctgccttatctctggttttatcctcttgcggggataactgcattcctgactcttcctctattaattgacctacttgaagtgtaatacttttagagagaagtaggggcttaactctgtccttaacaggcctctcgaggatattatctctcatcatcatgttccctttaacaagggagttgtctgtgtgtatgacaaattgcaaatgaggaccccccaccgtcaggctggggactaaaactgtagctcagctgttgtcgtttcacagatctcacgtgccatgtgtgtttcctgagttaacttggggaccgtgatacagagcgatgcggagatggctctgaaggacaggcaggtgccaggcgagggatggaagtgctgcttctaagtcagaaagtggaaggtgtgatgtgttaaagaatggaaagctaaatttggaggtgacgatgaggaacccaccgtatgctcgccatatgcaactaggaagagttgtaaaatcctgctccagccaaattggaaagtgctgatcaagggggaaacgatcaataacagattggagggggacggccacttcaaagtgtctgcggtacttgatttcattttgcaggggaaaccatatgtcacagtggtgttcatgaatttgggtgttcacaagggcttctgtacagctccctcccaaatgtccgcgatttacttgttggtatgacacataatggagatttttttaaaatggacatacgaagcacataacgtcaagttcaccattttaaagtgtacaacttggctgggcgcagtggctcgcgcctgtaatcctagcactttgggaggccgaggtgggcagatcacctgaggtcaagagttggagaccagcctggccaacatggtgaaaccttgtctctactaaaaatatttaaaaaatggccaggcacggtggctcacgcctgtaatcccagcactttgggaggccgaggcgggtggatcgtgaggtcaggagatcgagaccatggtgaaaccctgtctctactaaaaatacaaaaaattagccgggcgcagtggcaggtgcctactgtagtcccagttactcaggaggctgaggcaggagaatggcatgaacccgggaggtggagcttgcagtgagctgagatcacgccactgcactccagcctggggcgacagcgtgagactccgtctcaaaaaaaaaaaattagctgggcgtggtggcgggtgcctgtagtcccagctattccggaggctgaggtaagagaatcgcttgaacctgggaggtggaggttgtagtaagccgagatcacgccactgcactccagcctgggtgacagagcgagactccatcttaaaaaaaaaaaaaaaaagtgtacaactcaattggcttttaacatctttgcaatcttgtgcaactgtcataactgtcataactgtctagttccagaacacttttcttaccccaaagggaaacccaaagcccatcggcagtcatttctcctcccccaggcccaggcagtcaccagcctgccttctgtctctggagatgcctgttctaggtactccacacaaatggagccatacagtatgtggccttttgcgtctgggctctttccttagcatctggaatgttttcaagattcctccatgctattgcatgtatcagtaatttaatccttcttgtgtgtgcatgtgtagagatagggtctcgctttattgctcaggctggtcttgaacccctggcttcaagtgatcatcctgcttcagcctcaactctttctatagctgaaaaacattccattgtatggctagtctacatttctattttatgggttcatctgttgatggacactttcatggtttccaccttttagctatttgaataatgccgctatgaatatgtgcatgctagtgtttgtgtgggcccctgcccactagtggggttgctgggtcatatggtgaccctgtattttacctccctgaggcactcccaatctattttccacagtggctgtactatttgtccatgtctactagcagtgtatgagggctccagtctctccacatcctggccaacatttgtcactttctgtattcttacattgttattattatgatagtcctagtgggtatgaagtggaatctcatcgtggttttggttttcatttccctgatgattagtgatgttgccatcttttcatgtgcttattggccatttggaggagtctctattcaagtcctttgtccattttttagttgggttgtttgtctttattgttgagttctatgagttcaaaatggagacttttaagttgaataaggtataatttctgttgtgaggacttgtttcctttccaaataatatgtgtggtgtctgctgagagcctcatggtaacatttaattcttaaaagagcctttgtcttgatagattggtttcataaaactgttaagaggttcagccaggcaccgtggctcatgcccgtgggaggccaagacaggaggatcctttgagctcaggagttggagaccagcctgggcaacatagtgagaccttgtctctaattaaaaaaagaaaagaggttctttgactattgactatactgatcatatatatactgtataatttaataccaatcccttaagattcctgtgtgtttttgttaggagtcttttggttttcttagagctgtggtctctccacctggagtgtatgtcgggagaaagctcctgtcggggtgagtgcaggcagagtggccgaggagctgggcctctgtgaagtctgggtgcagcttggaggctcatagtggactgggagcttggcaggaggggcggtgcatgtccacaccagtgcccggtctccgccgtgctgcggccctgtgggtctctgctccccactcagcagttacgctgcaggacgttccttcccctccctgtgtgtgagggctgggtccttcctttctgatgtagtcatctttgatgggactccatctgcttgggcccaggggtccccacaggagccagctgtgttcacatcctagtggtccctggtcctaaaccacctcctgactttcctctgttgcttcagcttcagctctctgcccactgcattgtgtcgctggattttcaagattaaattccccccacaagagtgtttgatgcttccctggatggccaggctgtacggccagtgttaaaagacagacaagtgccacccaggggcaaggggagtgtgtggttcaaagtccctgagaacagatgccagatgccaggctcaggtggtgccgtttacttccagcaagaggagagagagggtgcacttgatccagtgccgggtgatggtggcccctaggccagggggtcgcaccctcactttgggctacagtagaaggagattcccccaccccgtggggtcttaaacacagaaaactgggggcatgcctgagggccactgatgcaggtgctaaggcacaacagaggagccatggaggcagaaatcgggaaagacccctcccaggtgagggctgcacgggctgtggtgagggtgctcccctcggtgggctctcggcccagcacgtggaagacggcgcagtccactgccttcccaacccagagaggccgatcagctccgcttagcttcacgtggtcctccgtgtaactggcccatctgtgggttggttctgagggagtgaggctgccctctagaatcacctgtgactggagggctgggtggcaggatttaaagcgcatagcagaaccgggaggattacccatggcttgtataaggaagagtctcttctaaagggttgcatgtgtggcaggctccttaatcaacatgctgcttaccccggactggaacatgccctgaagtcaagtcatttttgtgtagaatttttaattataagttttatttttataaacaaaaatcttagctgaagtccaataaaatccaagaagaaggcacagataatcagggagaagtaactcaagatttgaggaaatcaagagtcataaaagagtgctttgcaaaactttgcagataaattggaaaacttgtatgcgatgcataattttctaggaaaatataaatgaccataattgacctcagaaaagatagtaaagaaaaataaatggataaacatagaagaaagagaaagttaccaaaccattcctcttctaatcctcctccctctgaaggatttcaaacttgaaaagaacacaaaattattgaagacttctttctgttgtaggaagatctctaaaacatagtttctttatctattaatttagagacagagccttgctctgccatccaggctggagtgcagtggcatgatgttggctcactgcagcctccatctcctgggcccaagtgattctcctgcctcagcctcccgaatagctgggactgcaggcacatgccaccacacctggctaatttttgtatttttagtggagacagggtttcactatgttggccaggctggcctcaaagtcctgacctcaagtgatctgcctgccttggcctcccaaagtgctgggattataggtatgagccatattttttgttttttttaaatttatttttattgatttgtttttatatttttagaggggtcttgctttgttgcccaggctagagttcagtgatgcagtcagcttactgcagcctcaacctcctgggctcacgctatcctcttgccatatccttttgagtagctgggactacagatgtgtgccaccatgcccagctaatttttaatttttttttttttttgtagaggtggtgtcttgctttgtcactcaggctggagtgcggtggtgtgatcatggctcattaacctcgaattcctgggctgaagtgatcctcctgcctcagcctcaggagtatgtaggactacaggtgtgagccacagtgccagcttaaaatacgtcaaatttaaaatgcaaaagaagaaagtgtattcaacaggtttagtgtatgcacatatgactgatggagtcagccgttcctgcttgtcatatgtaatgtgtgtagctgggtgtggcatatgtgtacatgggtgggtagatccctagatagatggagggcaagtcggtggatctgcccctcctccactcactcagatgccttagagtgaacacggaagggagacatcagcctgtggcctccttagtcgttctcattttccttcgcctcttggtgtcttgctgtgttgactgattctagttttgaaagcagcatattgggtcaaaatacatttttttttctttgagacagagtcttgctctgtcacccaggctggggtgcagtagcgcaatctcggctcaccgcaacctctgcctcccaggttgaagcgattctcctgtctcagcctcccgagtagctgagattacaggcatgtgccaccacacccggctaatttttgtatttttagcagagatggagtttcaccatgttggtcaggctggtctcaaactccttgtaggtgagccacccgccttggcctcccaaagtgctgggattacaggtgtgagtcaacacgcccggcctcagaatacattttaaatcaggtctgtactgacttcagaatctaactccagaataaaatttgattctaaggggcaacagtaccacaaatgaggcgaagcacagaacatctgtcaccgtgacttggggcagatgcagaatgggactttcacctttttacacaaaacccttctatgtgccttctgttttaaaaccatgattttttttactttaataataggcaactaatttaaaatacctattcaccatgtgtcatctcagagtaggaaggggactgtgaggcagacggagccacttgggacttttgcctttgggttgtgacatttgtctgtaggttctttcacttctgtccatctcatttgtttctgtgccatgcgtgtgacatgatgagctggaaagactttgcatggggcccacgtgagtgctcacatcgaaggggcaagtgttaatcaccctctagttgacagagctgtttcagggatggctagttcctctgtccggaacacttgtattgagtggcagggagccgcggggacactgcccatagcggtgggagagcaagcaggaggggctctgcccagggctgtttcctttgcctttgtttaccagcataaagtattaaaacagctaaattatcatgggcattttaatccaatttctcagcgtttcgtcatttgaagaatagaagtctctttgttttcacagccctgttcttgcttgtttaaatttgaatatatttctattcattcagctgatagaaattctttacttttaaactgagggagaaaaaagaacagattgactagggatcagaatgtgatttcagtgggtctttattgggcccttgttagggaggggtttggacctggggacttggagtctacactgatggcagaagcaagctccagaaaagagcaggctccagctttgcaaggtaaaccttggagagtgtagttagggtgacagccagcacctctccctgctgagtggagagggaatccagatttttaggatcttataacctgatatttttcatgcctttgactcctgtcttggtctgttaggtcttggcttttgatagccaaagtaaccagctgactttccttctttttttttgaaatctcctttactttttcacaaggctgtttctcagtgtgaatatgttgctttcatattcccagagcactcactgaatgcataaaggctaagcaatgcagcagtgatactactaaccagctcttagtttactgggtgacctttggctggttctgtcgagtggccactctacctccagtttgccctgtctggagatgcagccaggactgtagattcccaggggagggctgacttactggggcatttatttactggataggggagtttttaatcttttagttggaatatttagtccatttacatttaatgtagttattgatacactgtgtatctggggttaaatccaccaccctcctatttattttagttttgtctcacctgttctttattttttctcttttcttgatttcttttgcattaagcagtttaaaaaattattccattttctccttctattagtgatgtatcagagaatacataagctacatatttgtttcgtggtaaccctaataaattactacatacccttactgtgagaagtgttgaagttagcacttgcaccacttggccagacagtgcaagaatcttgatgcatttaaccctcctacccacccccctttactttgcatggtgtcaacatcatggggttggagtttctatgtggattttaaaccccacagtatacagtcaatatttatttagatttatctgcttctttacacttattaatgttctttattctttcctgcatttctgtccttctgttcagggtcatgtttcttcaacctgaaaaacatcctttaatatttcttttagggtgaggctgccaacaacaatttagtttctgcatattttacctctatttcatttttgaaggatatttttgctgtgtgtagaattctatgtcaacttttttttaagtttaaaggtgtttttcccttcatctcctttctgttaaaacgtcacactgactgtaagtcttaatattggtgctttgaaagttccctccccgcacccccctgtccagctgatttggtttgtattactttacggagatgttcttagctgtggactacttcatatgtatcctttttggtgctccttgaacctgtggcttgatgtttctaagtactatcacttaagacactggttctctgccattctgtctcccctgctgacgctcattggaataggttagaccttttcaccatgtcctgtacatttctcatgttctgttccgagtttttttcttgctgtaggtcactgatcctctcctttgctgtggggcacagtctgctgtttagccaacctaccaaattcttgattccattgtatttttctattctgtgatttccattcgattctttatcaattccagttctctggtgaaaattttcaccttgttatctcttttcttgtacacatcagctttcagttctagccctccttacatcaacatctttgaaatggggggtgtgtgttgccatcagtctgactgctgctgatggcctggactcagctgttgctgtcagcacagtgtggacttgagggcatgactagacagaggccagtatttgtgccgagagccacagggctcacccgtggagggaatctgagtcccgattgtggaatggtggtggcagcatcacgtcctgcaggctggagcccatgagtggtccccgagagattgcctccgagcgctgttaggagagggaagagctgcactcatgcacacagggtgaccctgggtgaaatgtaggctccatggctccgagggggaagtgggctcagaagagtgggcttctgatctgaatccaagaagggttaggaataccttagccagtttctgtggctgctttttttcttttgaaacaggctctcgctctgtcacccaggctggggtgcagtggtgcaatcacgggtcaccgcagcctcgacctcctgggctcaagtgatcctcccacctcagcctcctgagtagctgggactacaggtatgcgacaccatacctggctaatttttatttttatttatttattttttttcagttggagtttctctctgtcgccaggctggatacagtggcacgatcttggctcactgcaacctctgccacctgggtttaagcaattctcctgcctcagcctcccaagtagctgggactacgggcacgcaccagcacactcggctaatttctgtatttttagtagagatgtggtttcaccatgttggccaggctggtctcaacctcttgacctcgtgatccgccccttggtctcccaaagtgctgagatacaggcgtgagccactgcgcccggaccatctggctaatttaaaaaatttttttgtagagataaggtcttgctctgttgctcaggctggtctcaaactccagggcttaagcaatcctcctgccttggcctcccaaagtgctgggatttgagcatgaaccaccgtgcctggcctgcaggtaatattcttttgtgtatatataagaatttaaatgaggccgggcgtggtggctcatgcctgtaatcccagcactttgggaagccgaggtgggcggatcatctgaggtcaggagttcgagaccagtctggccaacgtggtgaaaccctgtctctactaaaaatgcaaaaattagctgggcatggtggtgggcgcctgtaatcccagttactcaggaggctgaggtaggagaattgcttgaacccaggagatggaggttgcagtgagccgagatcgcaccactgcactccagcctgggcggcagagcgagactgtgtctcaaaaaaaaaaaaaaaaagaatgataaatgagaaacatgtctgagtaagttgataatagctcttcttactaagtatcagataaaaattccaaagagaaagtgttgtgtcgtgtcatgtcatagtttaattggcagttttttccttagtgacatagaagacagtgatggatcgtacaacctttggcaccttagagtttatgaaaaagtagcatctgttctatagaaattatggccacactctgaggagcagagttggggacaagagtggaaggaagagtctgatggtgacacggtctcctgcaggtcttcccagagccccattcaccacccatgatcactccctgccccgtttcccattttctttatattctacccttttgcggcaagggactaacaagggccatgcatgcctggcaacacaggcggtcccatccttcgctcaagccctaagtgacccctgctggccgcactcaatggtaactgactgctggaaggatggtcagccactgtccccaatgcaggcagccccttggtccccccattcccatcgttccccaccccatctccccacccttctctcagcaggagcctcccccataccaccccaagtcagcttcctaaaatgccctgtggctctggctcacctgctggaaacaaggcaaggtcaaggtcaagctccaacccccacccccagcccagctgcccttgggggttttcctctccctctgctgcgtttccttctcttgggcctgctcatctttctcgggctctttttcttctttgtctaagtcttactgccgacctaccacacttaaggttctcttctgctgccatcttctgtcggccctggcccctgagcacgggaccaggattggaagtggcaggggttgagggagttgagttagggtgtaagcgtggctgacttggtgaaatcttaagatttgggggagatctgaagtgccttgctctcaatgtcagtattgattgtggatgggttaggaggaggagaaaaattccaagtctcagcacaaggcgggtggctgtgaggagcagatgcagttcactattgcagagtcggagccggagaggcagaggtggaggccgctgacgccaggccagctctctaggtctcagcagaggagtcgcgcgggagccccaggactcactctccttgctcctagcaggcctcaactaacaacccttctccaccacggtgttgagccgttgatgggggtgatatgagcttgtagatgagttggggagacctggtgttttgcacccgtggcagtggcacgcttcttgggctgttctgctctgctttttatgtccgccgataaggtcggagagtctctccccggcgctcctatgcacatcttgttaagtttcttcttagagcttctgttgctgctgggaaagggatcccccaccaccccccgccccctttcttagtgggttcttaggatggcgcatgagagagttgctctttattgcctcctggttctcccagtatgggtttttatccatccagtggttccaagacagtggctgtgatgaacggagttgccgcgagtctcgtggcatttggaccctgcaccgctcgagattcactgcgctgcacaccagggcctcggtaattcagtcaaaacaacagatttagaggtgtacagaaagggccattctattttccattttgtatatttcatgtctctttaaatctcttaaagcttagaacacccgtttttcatatgcctttctaaaaacttttttccaggcgatttttagatgctatttatgtgtagtaaaatgcgtagatcttgagtgtttagtctgatgagttttgacagttgtatcctcctgcttaatcacactcaaagcaagatggagatcatttccactccccagaaagctccctcagccccctttccagtcagtttctcctggccgaggccagccgccttctgcctcctatcaccagaggctagttttgcccatggaactgaacgccccgatgagttcgtcttgtctgctgcacagacaaaaccaattcacggaggctgcaatattgtagtaaagaaagaatttaactcaaagccttgcaggtggaaggacgggagttttattattactcaaatcagcccctctgagaactcagagactagggtttttatggataatttggtgggcggggctagggagtgggtgctgctgattggttggggggtgaagtcatggggtggggaaaatggtcttctgcactgagtctgcctctgggtggggccacaggatgggtccaggtggggtcagttggttgccagaacgcaaaactctgaaaaacatctccagtcttaggttttgtaatgtgttgttttctacaggagcaattggggaagtcgcaaattttataacctggccacgactcccgagcagcaaggaattatagaaaggcaagctagggatgatggctgggtatcattagtgacatctacatcttagcagaattcaggcccctcacataatcctaatctcatggcctttcatagtcttacaaaggtggtttcagtccctgaaccaggaggggaccagttttagggagggactgttatcatccttgctttaaagttcaactgcaaactaaattcctcccatggttagctgtgcctgcatccgggaatgggtgagggcagccgcctgtgaggttaggagggaggtggaatcagccttgccagccttttctccctgtcataatcttgcccaggtggcctcacttattttttacctttttctacagtgaccacatgtgatgtattcttttgctcttgcgtttggcctcgttcactcagggtgaggcttctgagactcgtccgggcggcagctcattgctgggtgtcccggagcctgcacatccacgcagggtgcatccaccctccctctcccacaggttcacgctgcacctgtttccagtgactggcttttagggataaagctgccatgagtgttggggtgcaagtcttgtgtggaccatatatttttatttctcttgagtgtatgggattgcaggtcattgggtggttgtatgtttccagttacattttgcaagccactctaaattgacaaaaatgacaaaaatcatctctttctttgcaaagccaggcaatctgcagaggaatctttatttacagtttcctccagcactctggagacatggaagcgtaggcatcagtgagctgggaggtatttggttgtctttgaatgaattattaggtgagatattgacattatttcccctcaaacagtccacattcctgaatggcagggagtgaaggcagcctgtgcttatgtttgtgcttattatggagtgtgcacgtggatctatttaccgtgtggaaaataatagaatgaattgcttttacacattactgggcttaagaaatggaaggtgacatagcctttgaaaccccctctgagcccctccccagtcacagtcccctctgtcttcctgagctcaccctgtcctgattgggccttgtgccttcctctgcttgagactggttctgtgcgtgtgcgtgtgtgcaagcaggtgtgtgcacaagatgggctggcctgccctgctttggcacggaagcatcctccgctgggtgtttgttctgaggctcatctcacaaggatctgggtcctcaggctcccactgctctgcatcttccccgtgacagccgcgtgggcatttgctcttgaccctgtggtggctgagacagaaaccttggaggagtcactcacttctgttggagcaaaatgcaggcctcctccagggctgcgtctgggagggacttgggtggtggagtgtttatgacttagcgcagagggctcttacgtgcaaaccatcttggctgtggagcgccctgttgcctggaaggtctgccttctcatgggggctgggcttccagactcctgaaatgtgctgtgaggcttcctattctttcttaatgattaaaaatacgatttcttctttaatgcccagcacaaatgcatttagctgtgtttatttttttccctaagtaacagaagcaatcctgagaaaataattcttacactcagtattgattctctgcttcatgtgctagggtgttccccctcccactgaagttgctgctgcttcaccctctcctcctcgatggcctaccatcctgcagcctcgctccctgcgcctgcccccttctccttctcctccttcccctttcagtgcttgctcttccctcctttccttcttctcttcctcaccccactcttcccccttttctcctcctgcctctctttccacctcctcctccgtccctgctggtctcctaagaagcacttagtagcactcagaatccttgaccttggcaggcttgggaagtgttggttaatgaagggatgtgaagacgaagggagtctgagtctccaaaggaatcatggctgttgggagtttgcttgattaggagatgggccgtttattacaatgtgagttgttaactctaaagtgcctgagataaatttatagtgtttatttgcttcagaaggagttggattttttcttacaaagtgaaatatacttttctaaattttatgtttatataaacataatttatgttgttatagttttaatctgcattactcctcaaaaggaacaaaaatgttttggcttttttctccctgagctgcagagacctttttctcctgcttctgtcctctgtattctccccacccctttctccctcctttcttccctctttttaatctgtcaattaaaatatttgaaaggatatcactgagatctttgggcaaggactttacctgtttttgctgttgtcaaccgagggtgcggtggctcctcccacctgctgtctctggtttttactgggcttcctctccattatcctaattaggtggtttgccggttgttacacatcaaagacctgagtttcctggcgaggagggagggaggcatgggagcccctcattaccggcgtgcatcctaaccacactgcttgttttcttcttgagaaaatttttttcttttcttttccctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttccatgtcctttcctttcctttccatgtcctttcctttccttttcctttcccctttcctttcctgacagagtctcgttctgtcacccaggctggagtgcagtggcgtgatctcggctcactgcaacctccgcctcccaggttcacgccattctcctacctcagcctcccgagtagctgggactacaggcgcccgccaccatgcccggctaatttttttgtatttttagtagagatggggtttcaccgtgttagccaggatggtctcgatctcctgacctcgtgatccgcccactttggcctcccacagctgggattacaggcgtgagccaccgcgcccggccccccaaaaatttttctttagaaatgatataaagtatgaagaactcttggaagatcttcgtcggaaagatgaaggaagtcttgtttgtctcgtaaccctggaggccactgagtatctctccctcccatctgcctgtgcccgtgtatcctgcgtctgttgtgaaatgtttaccatgccttgactgggacttgtgggctgagcagggaggacaaacgttttatttttagtgactgtccctcaaagagctatactttcgatgcctttcaatatgaaatagtaaaaatcttgccatttgatattacctaaaatattactcttctccaaagttggtttgccaaaataaattatgtttattatctactctttctccttgatattatctaaaatattattcttctccaaagttggtttgccaaaataaattacgtttattatctactctttcttcttgctatgagtttaagaagactcttgttccctctccctcgatcaagcctgctgcagacacagaagatggagactagaagaagtgctaggacaagctaccgctgtcttcagggtgaccctgaagagttaggtccttgccgtgagtataggtgaggccgaaacaagtgacccggaatctaatcacagcctgggcagagtgtaggaagggcgcaaggatgaaaatgactgcttggttggacgcagcaaaatgttgattattggccatatatgcgtcactttgctagttgctgtggatataacaataagtgatacctcctactggcaaagaattctaagtctgatagggaaaataaacatcattcattcattcattcagcaaatgtttattgggattccactgtgcttcagcctctgtgagcagcgcccaacattgcccctgctgtagtggtgcagagcctcgtggggagatgggtggccgagcagtccgagaacccacctaaggagtggatggtaaactgaggcagcgccttgaaaggaagaatgctgtctgtgaagggtgatggcgagttctcttgaccagaagccatgcgaattactgcccgtgtcctctgatcgagccttctaggccactaccgtatcctcagagaaggctttatagtccagccaacagcactccaggaattgtctactcaaggaatgcagtaggtggcacttgttgagtgcattctgtgtggttaggacactgattcatcagggcctggattttcccaataaccccgggaggaaggcgttcccgtctccacgtccctttcccagcgtgccagtgctgatggtaggttctgctggatccctgccccggtgcatgttgatctttccagtacagcttgttgccccccagggaggcagggaagtaagtccataccacattggaagagttagacgggtcttggagaggctggagggggacagccgggggaagctccatagaggtggtgacgtctgagctgggagcgaagggagaccagggctgggcaaggtgggcaaagtgtgagcagacattccagtggaagccagaggagcaggctggactctgcatttgttcctactggaataaggaacaggtgtttgagtggatacagaataaggacttgatcgccttccttgctgacaagtgcatcgtgaggtgctcttttttctactcatcccactttcgaagtttctttttcttgactattttgacttaagatgcccagagttaataaagttgcataatttatcttcccatttaaaagatgtcagtggaagtcatagcaaatagtaagcccttcgcacccatgacctttgtttagctgagtctcttgggacaaagataacaagttgttgacacacgggagagaatgttagtattctttgtggtttcatgggacaaatatggaggctccttcatttgcttgatactaactgcagtttggacttaagcctgcagaggtgattggaaagattttcagtgaaatgagtggtgtaattgtgattgtgataatgcaggtgactgcttttcattcattcggttcccaccggcagcctggcatttagaaaaaagttaacctttctgtgaaatcattttagtgggaaaatccacaagggtctgccattctgtcagcaacaaaaatgccgtgggcagaacgaccttcagatgggattctggaaccacagggggtttaatgcaaacagatgacatggaagctgcacagaggaaacgtctggtttcaggcgcgggcatctaacctgccctgttcttcagtgcaggtttcagataccacagcagtaaacagttaccacatttcccttagtgtagcaggcctgaggggtagcggagaggcaggttgggcctccactagacaaagtttatcctagtgagttcttttgggttcaacttgtcaaggagggtggctactgagaggttgcctgataatctccaagtttcttccatctccatccatttttactcattactagcctttataaagtacagagtgagataattttcatcatgttcctaggctggcaggcctgggttctaagtattacttgaggtcatagagcaggcttgtgttctttgtagaaaggcctttgataggtggccgcaggaggtcttcgcgccctgtcccctcagcatgcacttgttctcccagagtcggccatggccattcttccaggcttctggagaaaggacctcctcacaagcagacagcaaaataaaacaatgaccagtgtcagagaagatgacacccccgtctcccatgtttgcacgcctcagcagttctcagccgtatgcctatgcttttacaagtgaaaaccagctctttaggtcacttgcgtcacagggatctcctcttttctgtccagctacctggcagtcattattcctcattgtttattgttagaaaccttttgttcagcagagcggctgccccagggatcacaggcagagcgggtcctgctggagtttagtctcaggacagcggcttgtccgcattcgggtttgagcatgagaatgttgttcccatgatttcagagaagaacaactgttttaaaggtcagattttattctgtccagtattctgtaaaggacgagttgaatatcaatgaaagaaagagctttagtagctgtggcagtgctgtgggtctgctgcctcccgggtgcttctcacaccacagaggctggagagccaggtgcccctgcagccagggctttgctcggggacacgcttgccggaggccaggctaccctaagtgtgcaccgagggaggtggtgggacctgcccgttctgctggctcagcaggagcagccaggggctgggggcttctggggctttctagggcgtgggaatgtgggtagggggcatttcccagctgctgcacaggccactggtcctggcctgccttccctgaaagctgagtccaaattcttcttctcttgcccttgcacggaatctgtaagtcacagaacacccggagtgctgcccttgctgcattaatagcaccagtggtttctggggaacttccctgacctcatccctgttgcatacagtagttcattctttcttttttttgagacggagtttcactcttgtcgcccaggctggagtgcagtggcgcgatctcagctcaccgcaacctccgcctcccaggttcaagcgattctcctgcctcagcctcccgggtagctgggattacaggcgtgcgccaccatgcccggctaattttgtatttttaatagagatggggtttttccatgttggtcaggctgttcttgaactcctgacctcaggtgatccgcccgccttggcctcctgaagtgctggattacaggcgtgcgccaccgcgcccggcccagtagttcactcttaaaacgccttgttatgtttctcccctgcgctctggtgacccccagacctctccatggagggacaatcttctgcaccaggagctcttcccctctgtggatcatctctctttcctcttcccttcctttttttcctgatacttctgatacttattcaaataattcattttttttgttcttcagtcgtcactttcatgtttgatttctgaatgcctctttaggcctggcctctgtctttgctcaaattgtgtatttgagacagtctacaacatcactcaggtatctttagatttgtcttgtctgagtggaattcatcctaaaattggaagctttagatgtacaagagatctgaataatagtttaaaaccattaccctcatctgaaagataaggtggtggggctgggacagagaaagtgacttgctcagtgaaatcgactgcagaccggactccgggtttcttggtttcttgttcactgtaaggtttgaccttaagccagtttcttgtcacaactgtctcatttccgaccataatacagagaacatcacctttaaattgtccctcttttatcaccatccacttagtcaccaggtcctacccgtcccttgtccgtgtcgggaatttgcgccttccctctcctttcccactccttgttctaattctcagtctttatacttaagcctcactgtcatgccactgttgccattagattttctgcttctgacctttttaagccttttaaccatccggagcgttgctgtcagcactcgattttgacatgacgcctgcccgctgcttcgtctttttctatttgtaccctatttttttgatggcactcgctacctctcacacactgtgcagttttcgtatttattgtgtttagggtctcttccccacttgactgtgagctgtaggaggccagaaattgtaatccatttggtaacagatgtacctacagctcccggccaggtggtcatccgcagtccacacacgcattcagctctggtatacgatagatgtgtagtgtagcagcacctggcgtttgcctgtagacgacacacagtagttgttgaatttgtgggacccttgataatcagccccccaactcccccccacattcatttctgattactctgaagcataaaccctccccggtagccacaagggtctcctcggtcaggggaatggattctccctggtcctaggggagcacacgctcgtccttgttaccctctctgtggtggagctgggttgcacactggaacttatcctcgccggggtcagtgatcctggaggtcggttgcctccatattgagcccctaaagcacctggccctgggaagagcgtgggccctggagcgtggcccagtatttcctcttctgttttgctgtatcctgaatttctcttctttttctttcatttctcagagtccaagtcacatcctgcttcctctgggctcaccatctctgccgtgttgctccacgggcccctcctggcctttagtgccctctgcagcctgtgctcttcgtccttgtgctgcccggcagccgatggcctttcctccaggctcggcacagtaggaagcgccaatgttcctgataatcaaatttatgggcgtgcgtgtgagagagagagagtgtgttcctgctgaagcatctcggttaaatcaaaacactctgtaattattgggttcttctttcctcttgccagaacactctctaattattggtttctttcctcctgctcttgacatttgatgtgtctatttgccctctctgtcaatagtgctgagtagaatactgcaggcacaagtcatgtttttgtaacgattttcgacagattagcattcctttaaaaaagaacttaagtcggttggggaagggggtccactcatattacaagggggatactttcaaaaatccttcaaataatggtaagagaagcagctttgcatagttgtgagggaacctggggcttactggagaagtgagcacacttctccaggcatgccatctgcagccttccttttctttctaggctgacctatggtcttctggtcactagtcattccatttggcagtagaatcaccttctcagttttgaaataggtgtaaccagtaggggaaaaggattgtggtgtgcgtggtgttctttgcgcacaaagatgaccgtggaatttttgaaggaggcaattattgtcattgtttaatatataactggaggcttaatttccaagtagctgttgtagcattaaatgtccctggctaggtgccagtagctatttccattgtacattgaatctattgcttctttttaaaatacaatggttcgtaggttgatttatctttattttaaagaaagggctaatatcacaaggtaagtttttgagcagatactatattacgaagtgttctgactcggatactggagaggaacagtggccctggatacctcctctgtgaaggtcaggttaagatctctttatgctcacagtataaagattaggtttggctgagagttacaggggagaggaaataacaattgtgtaactcaaattaaagtttgttcactcacattaagattccctagaagtagtcattccaaggctgtttagtgctccagcatagcaaggcctcgggctcctcctatgtttactttgctgtgcaaaggttctttttttttttttttttttaaatggttacctcattgtccaagatggctgctcaagctccagccattgcatatatgaggggacttcaaaaagttcatgcaaaaaaagaattaaaagataaaaataaaaaacaaacttctcagccaggcgcggtggctcacgcctgtagtaatgccagcactttgggaggccgaggcgggcagatcacgaagtcaggagatcgagaccatcctggctaacacagtgaaaccctgtctctactaaaaacagaaaaaattagccgggtgtggtgacaggcacctgtagtcccagctactttggaggctgaggcaggagaatggcgtgaacttgggaggtgaagctttcagtgagccgagatcgcgtcactgcactccagcctgggcgacagagcgagactctgtctcaaaaaacaaacaaacagacttctcaacataaggtctaacaagatcaagacacttttgtaaatgacgataccacccatttaatctgtccctaaagaacggagggttctaggagtttaactgtgtctatacagtctttttacattattttattttttgagacagaatctcattctgtcacccaggctggagtgcagtggtgcaatcttggctcactgcaacctccacctcccgggttcaagcgagtctcatgcctcagcctcccacgtagctgggattataggcgtgtgccaccacgcttggccaatttttatatttttagtagagatgcggtttcaccatgttggccagattggtgtcaaattcctgacctcaggtgattggcctccccaaagtgctgggattataggtgtgagccgccacgcccagccctctttttacattattaacagaaggaaaaatacgtttcctgtaaagattttttaaagattaggaaacaaacaagtcagaaggagccaaatcaggactgtaaggcagatttttaatgattgtttcccatgaaaactgtcacaaagttccccttgttggatgcttgttttggatgcgagcaatgagcaggagcactgttatcactgtggaggtggagggggctccctggtgacactttcctgggcatttttctgctcaagcttaggctttctcaaacactcgtaacaagcagctgtcatcgttgtttggcctccagaaagccaacaagcaaaatgccttgagcatctcaaagagcggttgccgtgaccttcgctgtcatccagattgctcttgctttgatggagccacttcttggtagccggcgctttgattgtggtttgtcttcaggatctgctgggaaagtcgtgtttcatttcctgtttcaattcttcaaagaaatccttcagggtcttgaccccatttgtttgagatttctgtctaaagctctgctctggtctgcagctcatctgagtgcagcattggcagccatcaaatggaaagtttgctcaactgtaattattcagtcagaattgtgtaagcgcgatggagaggtctgtgatactggctgttgtttgtgttgttaattgtcagtcctcttcacttagggcatgaactagatgaagtcttgccttgcaaattggtgtggttggtctgccactgagagtgtcatcatcttggccctccttaaaattaattgtccacttgaaaactactgatttctttggtgcattgcccccatcaactttttgtaaagcaccaatgatttcaccattctcccacccaaggttcattataaacttgatgtttgttcttgcttcaattttagcggaatttgtgttgctctgataagggctcctttcaaactaatatcttatccttcttactgtctcaaactagatcctgtttacacatgttatggaacaagttagtataagtttattttggggcaaaatgttttttgaagtacgtgcatagttttttttcttgaacatgaaaaccctttgtacatttcacctttccggaaagaagaagtagggaagaagaccccactgttttcctttaaggatgtttcttaaaagttacactcagcactttcacagggaggctggaaaatatctaggtgaccctgtgtgcaaatgaagaactggggattctagttatggaagggtggggtggatactggggaaaacgaacagcctctggcataggcgccatcctggctgatgctgagtttcttcttttctacctgagcttagctaaaatctcgccaccacgcccagaagagaatgcatttgctttggagttttctgtaatccttctgaattggttctaaattggtggccggcgcctgtagtcccagctacctgggaggctgaggcaggagaatggcatgaacctgggaggcgaagctttcagtgagccgagatagcgccactgcactccagcctgggcaacagagcaagactctgtctcaaaaaaaaaaaaaaaaaaaaaaaaaaaaaaaaaaaaaacaacttctcaacataaggtctaacaagatcaagacacttttgtaaatgacaataccacccatcttgggatatgatcaaatatacactaagaatatggaaatgaatcgtcctgacgtggaggtagaatactcaggtgaccagttgcttccaactaggactcagtcacccctggcttcagaagggcaggagacacgctgtgagaagctgtgagagtgttggagatttaggatgattctcagttcgcagattctttgttcagctatgtccagtctgttttgaagcctttccattttcattttaagttgttttttttcttacaaattctgtatagttatttatttctgatttggatgtctgaagtctttttgtatctgattcagctacagtttttgttggctgttcgtcatggtgcctgtttcctaatgtccttttaaattttgacagttattttcctttgaaattgaagtatgtgaaatctttgaagcttgggatgaagttggcttcttttaggactatgaagtttgcttctatcaagtgcttacaggtcctgacagtctgaggttttctatcacacccgggtcaaggccagccatccctcctctctgtttattactaggctgaggggcagaaacttttccttgcagtgccccggtggggtgggtttactttcgggtaaaccttgctctgcgtctgcagccctctgcacacccactcttctggagggatgccctccctcagacaccatgccagcacgggccttgggcgttgcctcctgcccctcaggccgcccatgactgcaacgccccactccagttcatgggctcaggcccgcggaacccggctgctctgctcaccgggctcgggcccgcagaacccggctgctctgctcaccgggctggccccagcttcactgctctcacaccagcacatccgtgaatttcagaacgtgcccctgcctgcttgtctgccccccacctccaagcattttcacttgttagtgagaggaacctggagcctgaatccaccacattgctggacattttgtgcttgtggtctttttattaccgcagatgtgatttccttgcttgtttcttcaagagcctactcttaagaggtatgatgaaatacttttgagagtgtgaatttcactaaatcacaaaatctgaaaggtgtacaagcagacaattctgaaagaaatagaaaatgtagctgagtgtctagtatcaagtgtagccatttctggtgataaattattatacgcattaggtggatagttttgtttactaagaattgaaggtaattctggaaattgataggtcagcaagcctttgcttagtgtgaggctaaggagtttgtcgtgtttatgcaaaatggtaatgtcctactgctgctttatcgatatggaaagttccagtaggttagaagtggttaagtaaagatgaatggcgaatgggatttgattaaatgtaaaagtttctgagggaagtgaatcactgtgtagatggagtcacccccggctattgatttaaatgacagttcagaaatagtatcaaaagaaacaaaatggccagcgtgtcaagaaaccagcagctcttctgttccggggtagccagcaccaggcatcagggcccccgggacctctggacatcagcgctgtgggtcgtcttggaattgacacttgagggcagatgaggcagcaccagctcctgggtgcctctgcacccagtgccctgtctccgcagtgagtgaggctggaccgggtgtgccagcatctggaggggtctgcagggtcggaatactgcatacagttggattttgaggtggagcattagctaattaactgcaaccaaaagtaaagtagcagggtggctgcttctccaggcctggaagcctgcgtggtggctgaactgcggtccccactgcagcagaaccgggcaggcctcagtggcctcaggctctgtccctgtgtatttcatggagaacagagtcagggaggtgcagggctcatcgctagccagggcacagcgggaccaggcatcctgatttgcagcctggtggcctttacctagtgccgcctcatctgacataaagtcacccgtgtgggggagagctgtattttaataatcagtttcaggtagatcccggaaacccaaacatatagaaaggtgagggacttcggttcccacctcctgagcaggtactgcctcgtgccagtggacctgggagggcgggaaggctgctctcaggggcacgctgttgcattatgccatgttgttcttttggttgtttattgtgatgagctcttattgtgataagaaaaataatcattttctcatctttagcagtgaatatacctcttttttaactgccatgttaacgtttgcctttgacagtgtgctctgagagacacaatctatgcttcaattctatgctcttcagctgtcataactcttctccatgtctttgaagtgcagtaaagaaagtgtaacccaaaaactgaacagtaattcctaaacttggcacttgctctccactctggagacattctaggtttcatttgagagggattttggcctgcttaaagcattttaacagcttttcgttggccccagtacaaagtctaaactctttacctgggaggaaaaattgcttttgatctggtccctgctctctaccacagcctcacctcccaccttccctcccaccagactccagcctcacctcccaccagactccagcctcacctcccaccttccctctcaccagactgcagcctgactgctgacatttcagtgtgttccaccttttcaggcgtttgctgggcagttttctcttcctcaacttgttaaattctattcatgcatcgagtcttgctgttgatgtcattttctttggaaactgttcctaaatccttaatcctttctaccttacaaaagaataacaaaataaaccccaagaaagatctactcctttattctttcacaggatatgattcctactccatcattgtcttcaactgtatggtgtgttgttgcgatgatcgtggtagcaggattgatatcagtattgctcactggtctctagtcttctagaaaataagggatggggacttccaggtagctgatgaaatggttgtgtcttaggttcctgtctccaaagtatttcctccagaataatgtagaagaacaagaaggagaaaagtaaactttgtaaaagccatgtcctcagtgtgaaagacacaatatactccaacttgaaaatcgtaaaaagaggtaacacccaatccaacatggaattcctgatgttctccatctccccactaccacaaggctctgtccaccttgggttgtaggtagttgacagaaaattataggtacaagtttgcagcagaaaaagacaaaaaggaaggagaaggaccttttgacatatgggtggatggcgaaaggaagaagaatcagcaggggaaatttagtgtcctgtagacagggacaaccacaggttgggtgtggtggctcatgcctataatcccagcagtttgggaggctgaggcaggcagatggcttgagcccaggagttcgagaccagcctgggcaacatggcaaaaccctttctctacaaaaaacaaacaaatagtattgtacaaatgagtttctggtctcgttaattatactattgttatgtaagacctaatggtcgggcatgttgggttaaggccatgtgtactagctttgcaacattgctgaatatctaaaattatttcaagataaaaattaagaaaggaaagcagtggttatgcctgtttatacttgagccagagcaacgcctgactcagaatagacagtcacccattcacgttttctaacttcagattgtgcagttgtttgttggttcttgggtttttaaataatgcatgaagaaggtggaaggagcggcgccctgggattgcagtatcgtggtgttgagtcacttgcgatctttccggttcagtgactcctcagtgtgcgtggattggggccctccagagatgctctctgtctgtgtgtgtcatcgcagccctctgctgtccatgcccgacaagccagtggctttcactgctgtgtggggtgggggcgatgtttgtgtttgttttattccaacagtggcttcgtttctcttccagggcatttctctcgctcttcacaagaagtggcctctgcttcttctgattattcacactgtccattattgattactccttatcccctttctttcctctgcatgaaaggcaggtctctgccgggcgcagcggctacctgtaatcccagctactcgggaggctgaggcaggagaattgcctgaactcgggaggcggaagttgcagagaatggcctgaaccccagaggtggaggttgcagtgagccgagattgtgccactgcactccagcctgggtgacagagtgagactcccatctccaaaaacaaaaaaagaaaggcaggtcttttgtgaattgacggctaggctcacttcctggagggcagtcggctggctcaggcacagggcgggaggaaagaggcttccgcacagccacgttctcctcattcctcacctcgtagaaaagatttttggggggtggtggttaatcatgttactctaagttttcgtttcctttttactcggctcaggaatagtaagatgcctttacaggcccgtttgaatgcatttaaacttaagaatttctgtcatttttccctccctttttgtttctcttagcttattttttgagcctgcaaactttaaatttttattattctgagaatagcttatttactaacttaaatcctgttttgaaaaaggcaggttgtgaaaaagtaaaccataaatagtttatagctgtaaggagttgaagtgtcttcagaattaatatttatgtatttatttgaagctcagtttagctgttgtcattcaaagttctgcctcaagtatgcccagatcttgtcagttacacagccttcctttctctgctttctcttcttcccaattcttccagcatctcaagaggcagggttaacaattccactcccaggctgggtgaggtgtcctctccacggttccccagagcccagagaggcggagggagccccatggtccctgtcctggagaggaagacctcccccagagtccagagagagggatggagcccccatggtccctgtcctggagaggaacctccagttctcggtcagggccaagacccccaagtgggtcacagttacttgtttttcctcttgccctcctcagcctgctggctcttctgtgcaggacctcagactgccaggctcctgctctcttcctccaggcacatcttctcaccagaactccagccctgcacctcagactccctgttcattgtctcacctcagccccatctcaagtctagaaccccctttctttcttgttgacttattccgttctaactggaatcctagaagagaatgacaggatgatggtgctgtgcctctgaagggggtttgttaaaatactcagaatcagcagggcacggtggctcaagcctgtaatcccagcactttgggaggcccaggtaggtggatcatgaggccaggagttcaagaccagcctggccaagatggtgaaatcccatctttactaaaaatacaaaattagctgggcgcagtggcaggtgcctgtaattccagctactcaggagaggcaggagaatcgcttgaacccaggtggcagaggttgcagtgagccaagattgagccactgcacttcagcctgggcaacagagtgagactctgtctcaaaaaacaaacaaacagacaaaaactcagaaccatgcctagaaaatactcagggctccctgtttgttagataaattgttagatcagccaatgagtgacatattgcatcttgtatgctgcatcccaggggatttagttagtgacagaggagaaatacagctcctttgcaagtggtcctgcgtgccgaggcaaagatccgcgtataaaatcccacgtcgcacgtatgtgctgggctcgtctgtgaacaggttacatggaccctctctagacccagcagatgggctttgaaatgtggccttcgtgttcagctggcatttggttttcaccaggagacaacagcaaacacacaggcggaagaggagagggagcccgtgaggctcattgtcaatacaggggagacagccactcaggacggggcttcaaggcatgcatgggtttgacagaggtgaggggcctggcgcactggagtccaggctcatggagggaggggttggtttggcatcttctctttagcacctgccacgtgttctgcggaggccagttagtgtcagtcagcaaaacaccacctccaaatgctggcagtggagtgtctcgctttatttttttattcagatcgataactcctaggaaaagagcatcttttagagtcacctgaaactaaataaagagcagagtgcctgagttgtggaaacactggtgctgtctgggcctcatggcagaaagttgcggggccgcggctctcgttccgtcctcacactgccctgctagagtgcgtgcgtgctgtgtgcattcctcatgccgctgctgtccctggcaggtgacagttcaggggcacctcgcgctgtgggtgagttctcgagtgctgcggggagtgtagggaaggccggtggtgcggtatcgaggaccaattctgtgtgtgtggttcaacatttctagttctcttacaccttcatgaggtgtacgtctcttacaccttcatgaggtgtacgtctcttacaccttcatgaggtgtacgtctcttacaccttcatgaggtgtacgtctcttacagcttcatgaggtgtacgtctcttacaccttcatgaggtgtacgtctcttacaccttcatgaggtgtacgtctcttacaccttcatgaggtgtacgtctcttacaccttcatgaggtgtacgtctcttacaccttcttgaggttgaatttcatttgattcttaaatatttggctgaaaaattagataataaacgtagttacaatctctcctgtcatgaacactgaggaagaatgaatttgtctaaatattctctcggtgtattagaatattggtaaatgatgtggaatcttcctgtatttgatgtgatataatcttatcagttctttaaaatgatgtagcaggctgaccgttggccccccaaaagattagccacatcatattttctggaacctgtgaatattacctcatgtggtgaaagatgtgattaggtccccccccccaccccaaacaaagtctcgctctgtcatccaggctggagtacagtggtgcaatcatgggtcgctgcagcctcgacctcttgggctcaagccatcctcccacctcagcctcccaagtatctagaactacagacctgcgccaccacacccagctaattgttaaatttttttgtaaagtcaggggtctccctatgtaactcaggctggtcttgaactcctggactcaagccatttgcctgcctcagccccaaagtgctggattacaggtgtgagccactgcacccagccaggttaaggttgttgagagggagagcttatcttggattatttgagtgagccctagatgtaatcacgggtgtccttatgagtgagaagcagaggagctttgagtcagacagaagagaaggccatgtgaagactgaggcagagctgggagtgatgtggccacaggccaaggaacaccgaggcgtgcccacggccaccagaaactggaagaggccggaatggatttgccccagggcctccagagggagcgtggccctgctgacttagtgattttgcatgaatacttgagtctatagagtttgagaacaaggactttctcttacataaccacagtacatttatcaaaattaggaaatataacattgattcagtcctgtgttctaatttgtttcctttttttttcttaaaaaaaagaaaaatagcgtcttgctgtgttccccaggctggagtgcagtggtgtgatccatcatagctcactgcagccttgaactcctgggctcaagtgattctcctgcctcagcctcctgagtagctgggaccacaggcacgtaccactacacccagctaatttatttattttttgtagagatggggtttcaacatgttgtccaggccggtcttgagctcctgggaaccaagccatcctcctgccttggcctcctagactgctgggattacaggcgcgagccaagcgctcagctgatcgaattcatttcttagccagttgtttcagctccgtctgtggcagcctccgcactggcctgggagcggaccccggactacacacggctttttgatggcacttcatcctcctcagctttgctttctcagtctggccatttttgaaggatgcgggccagttcagttctaatcctcagtttgcgttttcctcctgtcttctcccgacaagagcagggcaagcatctgtggcaggagggctgcagaagtgatactggggcttcctcaggtgctgtcggaggtgctgatggcattttgtcccatgattggccatactcattttgaccttgattaagatggcgtccccacatttctccgctgcggagttgttttccctttgtaagtaataaggactctggctctgtgcctaccctgttccttgtgctggttttgcaaccatggataattcttgcccacatcagttatgatcgtgatggttgccaaatgctggttttctgattgtatgtttttcttcccttcgcccccattcattccttcattcattcctttatatcattctaaaataaattcttattttatcccatcaatcatctgctactgtcattgtttattttgatgctccagttgtccctgatttcgctgccaccctccaagctcactcctgtccatgtgttttatgtgttctcttcactgttgagcaattccttgctttcaggcacgacaaggtggagcagcctcatattctacccgcatggctcaagtcctggcatcagccacgtttccaaggagccctggttccttttctacagaatgggacttagaagccaagatgtcggctcctggcattgactccctcatcctcaacatgccgctcagttgcctggtgccacaatacacaggaagtaaattcagaattgccgtctcgtaccatcgtaaacaaactttctcacgtgaattcactatctgttcccagttattttctgcctgtggactgaggggtggagtcaggtgtagatgccatggtcagagttacttgggtgggctttgtcccctctgttccgggctgttatttgcactgtactcaagttcacgtgtttagtttgtattctgttccgttgcagggctctcttatccttgcttatttcttcttttatgagtatgtaagttattaatgtggttctgcaagtcaaaactgtataaagctagagtcatgtcatctccccaatcctgtttccaggctgccttgtgtttcattactttcaggcatatcttgtctttcttttttttttaaataaggagatacatgtttatttatttatttatttatttatttatttatttatttatttatttaatttttctggaggcatagtctcgctctgccgcccaggctggagttgcagtggtgtgatctcggctcactgcaagctcctcctcccgggttcacgccattctcctgcctcagcctcccgagtagctgggactacagacgcccaccaccacacccggctaattttttgtattttttagtagagatggggtttcaccgtgttagccaggatggtctcgatctcctgacctcgtgatccacccacctcggcctcccatagtgctgggattacaggcgtgagccactgcgcccagccatgttattttcttatatcctgctcttacatggcaagatagtatactaggtatgctcctctgcactctgctttttgccactacacagcgtgtcctggaaatcactccatgtcagtttctagggactttctcttccttttttgagagctgtatggcacttcattacgtgagtcaacatcttaacattgtaacattttgcaattacagataataccgcattgtataaccttgttcagatgtattttgtattaaggctgtatcttcaaggtaaatttatagtatcactgggtggaaaaatgtgtatgtagtttttttctagttattgtcaaattcccttcctacctcaggattgtatacccttttccattcccctcggcaacataggagagcgcctcattcggagtcgcccctcattcagggtcgcacctcattcggagtcacccctcattcagggtcgcttgttgcgttttcagtgtatgccagtgtgtgcagtctgggagatgagaaatgctctcggtgtagttttaatttgaattatttttattgtaagtgagttgaggtattgctctgtctcccaggctggagtgcagtggtgtgatcttggctcactacagcctcgacctcctgggttcaagtgaccctcccacctcagcctcctgagtagctgggactacggccgtgtaccaccatgcccagctaattaaaacatttttttttttaatgtaggaatagagtcttgatatgttaacttgaactcctggggtcaagtgatcctccatccttggcctcccaaagtgctgggattacaggtatgacccactgtgcctggctaatatttttgtatattcagggccatttccatatatatatatatatatatatatattttttttttttttttttttttttttttttgctgtgaattatctgacatgtcttttgccatttgcctcatggaatgatttatatttccacgacttttaattcctagtgacagctgctactccccacatcgtggggtgcttcctttgagcttcttcccagctgcctctggctgttgaactccctctagtcgtaagcgtaagatggacccccagagtcgtcctgggagcagcactcggaaatgcccgacaagaaccctatttctcctcatcaggtgggggcactttccagtcctcagagctcttctgacagtgttggtggcctctgcagagggcagggtcatcctgtgcctggagggacataagcatggttagaggctttctagaagggattcaggcctccgacccatctggtgctgttcatttttgagattacgtgtctctaagataaaggattgggaggatgggccatggtttatagagcactggtcactgagtcttcctgtgcccagatgtggggctcagcacttgctatgcataaactcacctgagcttcataacaactttttttttttttttttgagacagagtctcgctctgtcgcccatgctggagtgcggtggcacgatctcggctcactgcaagctccgcctcctgggttcacgccattctcctgcctcagcctcctgagtagctgggactacaggcgcccgccaccacgcctggctaatttttttatttttagtagagacggggtttcaccgtgttagccaggatgcataacacctcctttgaagtagacgcaaccattgttcccagttcacagattagaaaactgagacttaagtgcgtcactgtctagtgcagttctaccctcacgacaaagccatgtttcttccccgtgaatgaagagaaaggtaaatttacagtatttgcctttcgggactcattggtattctctcttgaaacacttcttactgcataattcagagttctcggcagcgtatccatctcttagaaagggctcttcctgggaaggctggaaagaaaggctctcttctaacgaggccggtgtctcaagcactccactaaatatgaagaggtacttgcttgatttttacaaaatcagctttgtgagaggatgagtggtccagcccctcgcccagctgtgtgagtcctgagcacctgcgcttcagagtaaggctgttggacctgggacccttccatgaaatttattttcaatcttgaatgagatttactttaatgggaggccttaaaagcagatgccatgcgagttaaaatcacacagcttattgcatctatcagttccagtcagagctgatggcaaactcttgttctttcagttcagtaaccagagagtggaatctgtctgtctgtgtcttccataaccaaaatacatcaccccacgcaatgcctcctaataactggggctttgtggtcagggtttttgcagggcaggccccttttctgcaggcaaagtgctaatggccagcgcctacactgcaggcctctggcgcattctctgccgagagttctgtccgtcccacttctcctcactgtctagtcttcttctgaccctcccagcctggttcacgtttgctcttcgttaccctcttcctgtttctttctcctgtctctcctcccaccacaccatccctcacatgcaccatggggtgctccttcagattgtcatctgatcgagccacagtcccactcagcccatgtttgtcaggactctgccactggtcacttgtccacaaggaaccactgtctttgagcttcttcctccggtgctcttagcatctgcccacactgtatctatctgtgtccaggtcttgttttctgtgtcattgtttgatgaaaggcagggactcattcggtgagtgggtctcccctgcctctgccccacaccagcacactgctctgcccttggtgggcacccgttggtgtgtgttgagctgggtgttgtacctcggtgtctgcgtggagaaatgcgaacagtgagtgccacagcacagccacggaatggttgtcatcggcttcagaaggggaatgaaaggggcagcaccgtgggtgttgatgatctccgaggctgcctgtttagagcgtcccttccctgagatggaggcgtagcttcaccgtgtagtgtttaagctttaaaacgtgaaatgcagtgaggccgacagtgagttgtaggaagctcagaaatgggatgcccgcactgccttcaattcaccctccattgtccatcgccgctggcatacccaggtcagcgcctgcaggcccctgtctcaaaagatgtggccggcttcttgtcccggtactgcctgaagcttcacctcagcaccgctagcttcacactggccacacccacctccactcagcagtctccatgctgtagcccaaagcatgtagtggcggttgagtacctgagtgggggaaataattaactgggatgcttttattgataagtagtcagatgcctgttaagtgacatttatgaacactcacgtagcactgctgcctgttagccaggcactagtcaaaggacttttgatgtattagctcatttaatcttcacagaaactagaagttagacactatcctctccactcccttcacccccagccccaaacacacacaattttatagccgaagaaacggaggcacaaagaaggtgaagactttgctaaagtcacaaaactggtataagcatgggctttgtgtgtgtccaaagttcatccctcaaccgtttctctctggatcaataattaaaaggtttatcaagaagtctgaaggtaaatggttcagtattgtcaggttctggataagtttctctgtgttcttgacttttccctcatgatgacaagaaggctgccaccactccaaacatcacagcctcacagttgtgctcaaagggagaaagaagaagggacggccgttctcctttgagcacactgtttcactggcttcctgtgggttccactggcctgacttgatgcctgggacactttaagcatctccggtgctatgcgggctgggaagaagtgagctgtagaggcagccagtgttactctctgctccatcccttttttgttaattttgcggttactgttatttaaactagatgtatctctagggcagtggcaggaatcgactccaaggacactgaccagcttggggctgctgcctggcccaggccggcgcatgttggaacacagactctctgcccttccaccccaagcctggtgggcgagtgagtctgcccagagggagtgcctttttctgctttacacaaggcacctcaaggggtagaggtggcctctcctgcagaacggcagctgccctgttgccgttctgataaattgcaagataaaactgaagtgcaaggaaggggcatttttgattttggatatgactttgcctaaaaatggcaccttaaggtgttttaaacatttatcaaacggtttcatatgtatggagtatgtctgtgcagcattcttaaagtgacaggactaccttatgaagtcagtaaatcctttcatctccccagacagccagaagctagtcagcagatgaacacattcacttgtatgttccccttggcaacattattcctagagaggttgcatctgcatcttggagtccgcatgataaatcatttatgtactcacagaaaccatgcactcccccgtgggaagagttctaggtgtagcaggggcggaggacgccacctgctccctgacatccgtctttccgaagccatcgctggagccctctgctgagtgtgggcagtgaggcctcgtcttacgcatgtggtcagaggagataatgtggctagaagtgctttgtaagcgccaaggattgctgttatgaggaatttactagatttcaggctttcatcagatagttagcgaggaagcgcaaaagcacagcatggtctccatgtttgctgacctgcagcgaaaagtcagaaagctaattggaggccattcataggctgattctaccttacaccatcattatactttttgtctataagactggagaagatctttctgagacatatcactatcagtgttttacgcgtatgaaacatatttttctttccttctttatgttcatttttaaaatttttgatcagtgccctcaagcattctcctattcaatagaaaacatatttttctaggtatgataatctttcagatttttggtatgtgtacctttgctaaaaacacatttaatatttctacctgtctggacaccttttaaaaatgtctggctgcaccttggagaaacgcttcatgcaagcagattctaattaaagtaggaaactttactttaccattaagttatatgtaaaagcattctaggggagagtcttttaatcattgaaacattttcaaacgtgtttgctcatttgcttctttatttgtttttatggcttattcatttgtttatttttaaactttttattatgaaaaatttcaacatatacccatcatctatcttcagtcattttcagctgccagttccagtctcctttcatctgtgcccccacccagtccccccttcccactcccctggctgattaggaagcaaatcccagacttcatgtaatttcacctgtcaatatttctgaaagaaatatttactttctctaaagataagtatgcttctaaacacacacacacacatacacacacacacaatgtttgtttgaatcaggatgcaagtgagatgaatgtattgtgagttacttcatctattctgttaatccatgtaattaatccaaaagtcagtccctcaccccagcactctctgtgcacctgtctgcctgtctctttctgcagttgattggttgaagaaactggatcatgtagcctgtagaatttatcgtggtctcgatctcgtcagtggcttctccccccttgccctgggtgagccacactcacctctgctccttggatttcctctcggtggtggacacagccgggctcccctagattctggttcagtcagggaatgtttcatgtgtggtgctgtgtccttactttaggatatctgatagtccctctgtgatattagcagctattgatgatcattgtctggatctatttattagagattatgaaaagatggtgttattgtttcattcctttttttgcaacaggggatctcacttggccacccaggctggagtgcagtggcgcaaacatggctcactggagcctcaaattctcgggcccaagtgatcctcccacctgagacttccaagtagctgggaccacaggcacatgacactatgccttgctaatttttaaatgtcttgtagaaacagggttttgctatgttgcccagactggtttttaattcctggcctcaagcaatcttcctgcctcagcttcccaaagtgctggggttacagatacgagccactgtgcttagctgtccttatttgttaactggagtatctctatataaagaaaccctctcatcaattatttggatagctcaaggtacagtcatagaggaaagccagcatcaatacttactttcctttattaaccagttttcaaaatcgtgtgtgggcttctctcaaaggtgactagtaaggggtgtgtgggtgtgatatgtgtgtgtgcatgtcgtgtgtgtgtgcatgcacgtgtgtgcatgcataggtatgtgtgtggtgtggtgtgtgtggccaccctgttgaaggcactacctactgtattcgtttctcactgcatctctcaaaggtgactagtgtgggggtgtgtgtggatgtgagtgatgtgtgtgtgtgcacgcatgtcagtgtgtgcgcataggtgtgtgtggtgtggcgtgtgtggccaccctattgaatgcatgacttactctattcgttcttcaccgatgtccacgtcgttccatctttgtgttggcccctgagccttgtgatgcagttctcgcggtcctcaattgcttcattttgatatggtatgacaagccagcatgttctgtgccattttgtacttcttctaccctaggcctgaaatcagccacgtgtctgtctccagggagtcttggtttccttccatgggaagtggtatggagagcttaatctgggctccagggctgctcattgacccttgttcagccccctttctctatgggtgtttcaaagataaaatacgaaggcgctcttacacatccaggttcaggtctgcaaggtctgcttactctcatgggtcctacagctgtatctgcttctttccacatggagtgctcagattgttcatgaacaccaacgtaattacccattctcttatcctgcaccacacctggcagtttcagaaagcaacaccagcactgccactgacgcggttactgagagccgctgccgaggcatagccgctgctgaggcactcgcccttccttctcaggttaggcacagatgtcgagtgacattaccctgtatttttatttatttatttttgagacaggctctcactgtggcccaggctggagtacagtagcagaatcatagttcactgcagcctcaacctcctgggctcaagccatcctcccacctcagcctctcaagtagccaagactataggtgcacgccaccatgtctggctacgttatgttatgttatgttatgttatgttatgttatgttatgttatgttatgttatttttttgagatggagtcttactctgttatccaggctggagcgcagtggcatgatctcggctcaccgcaacctccacctcccaggttcaagcgattctcctgcctcagcctcccaagtagctgggattacaggcacatgccaccatgcccagctaattttgtattttcagtagagatggggtttctccatgttggtcaggctggtcttgaactcctgacctcaggtgatccacctgccttggcctcccaaagtgctaggattacaggcgtgagccaccgtgcctggcctaatttatttatttatatttttagtagtgatgaagtcttcctatgttgcccaggctggtcttgaactcctggcctcaagtgatcctcctgcctcagcctcccaaagtgttaggattataggcatgagccactgtgcctggctggattactttttaaaaaaattaattttgctttgtagttatgtaaaatatttcatgagtccaaagttaaatacacaaaatgaagtttattgaaaggagcctggctgctcttcctgtcctggtgagcctattttatcttttcttctgtaggtcaccactgaaatgttttaataatatgtgtaccacatgtgatgacacgtatgcgtaaccttgggtacatttatatacgcacacacgcacacagtgttttctctttagggaagtgctgtatgttgtacatggtttcttctaccttgcttcttgttgctgtattagactggaatccacgtgtcctcattggaatcaaagcttcattgtttcctctaaagcagagtttctccagcttggcccgattggcatttggatcagctaattcatgattgtggtggtcgtgtgctcatgtgctgtgcggacagtcacaggatgtgtagcaggtccccaggccattgccatcagatgccagcagggcccacttctcccagcagtgccgaccgagcctgtctgcagacaacaccagtgcccccgagggcagagttgctcccagcggagatggtgtttctcgggttcattggggggattctgagcacccatttcagaagtggatttggccccatctggaagcaatagcttttctttttggactttgaataataaaccagctattctagttcttgtctgcctcttctgcaaattaaggaaggaaggaagaattgttactgaataatacataaaggaaagagtcgatgattttacaaatttcacgtaactctgcccttactgggcagacacgtgttgagaacattacgagttactgtgaccttgtagtccctttgggttcggtgtacgcaatttcctactctcagcatctgccagcccagactctggcagacttatgccagccctgggtgctgtagggtcagccacccccttccacgcagggtgggcgtccagatggtgctgtgggaaacagcgttttgccaggggccagagagctgactcagatagtgacctggaaaacagactgtggatcaggtgggcacgggcctggaacagggtccctgaaacacccagcaagaggctggggaatgtctggagagcccggcatggtccggagcgtccacgcagccagcagctcacatcctcttgctcctggcggccgatgctctgcgcagaaacgggcttggtctgaacggagagggacattgtgaacttgaaatgaaatctgacaagaaattagaaatttcttcagaaagtaaagagcgctgtcaagaatgcgagctgaagatttgcgtttacagctgtagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacacagctggtgacctctccaggtgacctcttcaagcctggtcccaggggcaggcatgcccgggcatggccctcgcagatggctttgctggcctggtctggcaaccgttgaataaatactgatttcccacccaggtgaggcgcatggtagatgtttgttctgtgcattgcgttggtcggcctccacagtcgcacaatctctcagtggagtgagagtgtcttccatatgtggggccgtggtgctgaaggcttgtgcgttgagtgcctcctttcccgtgaatgtgttggttctggtgaccagggtggagcctccctgcgccccttccttccatccagcatcaggttcccagttctctgcctgccaggcaggcgtgcacatatggagtgtctgggaacctgcagctgttgatcacggctggtggtagctccgcacttaagtaaggaggagtgattttcccgaggagatgtggtattggtcggagttgctgggaaatcagcagcactgagtgatcaggttgtcgtgagctcctgcctccatccaccccattctggcggttcctggcttcactgcctcttgaagacagcctctctggcactcatgggcatgttggccttctcgaggggaaggggttgagtaactcatggcctgttagtgtgtgccagagactcagcaccacgggcagacacagtgccacgggcagctatatccaaggagggtgagggtgctccccagaagcctctgggcctccgtgggtgtcatcagggtagtgagcaggaagcctgggggctgagctgggctgcctggctttgacatgggcctgtgcggggctggctgtgtggccccgtgagggttactgaacctctctgtgcccagcctcctgtttgtgaggcaggagcgatggcagtgcccactgcatggtggtaagagtgaggcgggtagaatgcatgtgcccaagacagaggctgccccgacccgtgctgtgcgggtcactcacccccacattgtctgccacgggggcccgagcatttccacacgagactttcacatcagccacccgggcagggcccgcgttagtttagttgtttgtggaggagaaaattgaggtttggttttgttcatgacgttgccaggtcgaatggctggtgaatcattgatttggggctgagacttaagtttcccatctctgggcgggacctgtgctctctccctgtaacagtggcctctgttacagaggggcaggtgggtggctcacgtgtgggctcacctgcgtcacttctctccagctcacctccactgcgagagtgcctggggatgcctgccagccacccagagccagcgtcttcccaagcagctgttttacaggaaacaaagcaggatgaccttgggcttcctagtctctgcacgttaccccgaattccagaataatcgtgagaaggagccagtggagtggtgtgacttttgtatttatagacttcttccaaaggtcacctcttttatttctgaaaaacaagtcgcttgaggcccatctttacagagtgacaggagctcaggatgcagaggcaccaaggccagggaggagcgttgggggtggctggagctggtgggccaagggccgcagaccacttttgccctgcatggcctcgtggctgccttttctacctgcgtgagctggctttgatctaccccggacccatctttctgtgaagagtttgcagaggatgctggttacatcttagatggaaattggccgtgtctctgctgtttctgagtgtgcgactctcagagccaaggtggcatctggcgactggccttgttcttgtgagtccctgtagggcaggatagatttttccggcagggctgcagcctggagttcaggcttcctctcccttttaaatttcaaagactcagggttccatttaaacagacaagataagtggcagctttgttttgttttgttttttcattaagagattttggagggggaggaaaccagccttacagtgatagcatcaggaaaagattacacagaatggcatcttattatgaaatattgaaaacatttaaagagcaaataaaatatgcaaatagagtgggacagaatttgtactgcacagcctcttgccctacatctttcccaataaaaatttaactctgaggtccatgttgggacaaaaaaaatgatactgggatagtggagctcggctttcgttagttcaaagcgagcagcatattaatccaagtaagcagaattcccatgtagattcattccacagccttttcttgggtgacgactctgtgcccagaagcaaggggctgactgggacctgagaggcctcttcttagtggccatggcctcccggggcaaggccggctggtgcgtcagagcctggatctctgcagtgggcgcagaagggacacaggaattttctcttggcctctttgctggacttgcagcagggatgccgccgaactcagccgtttgcaggcgggagcacgtgagtgagcgagtgtgggatccagccagcccccccaagcaccaatacaggagcaaactccatgcggggcccacagccagaccaggtgtgtcaccttgaggggaacacggtggcacccaggcaagggtgcccatgaccctgaagccccagagtgggtgttagtgtgctcattagctcttttagttcttccatccacagtccaacagatggtggcatgttagcagctccgtcgccccctggccccatcacgtagggtggctgccctctgccagcaggagcaaagggctagtgtgacagtctttctggtaccagcacttggtgggtcctgagctcttgtccagcatccaagcagaatgcagatgtgcctacagtcagagagtgagcaaggtgaggggttttactgagtgatgaaagagctttctgcagagaggggacatgggggcggtccccccacccgaaggtgggaaaatccctccagtgtgtcttagtctggggcttttgtgggctcagaataggggaggggcaggctgtaggtagtattggaaaaggcaacatttgattggttaaaaggcattattcagaaagaatcaattgggaaagggtgggcaaacgggaataggagttttgctctgggtcttgggttttatccaggacctgccgtctggtctttcagccttcaggctgttatttggcttggaggtaggtttcaccagggacctgcccctgtctgcctaggcatttgactacctcccatcggtatcagaagcaccttgtgagccccagggagctggtgaggaccttgtaagggaggaggagggcggcgtgataggtgcaggtggcggcgtgataggtgcaggtggcaccgtgcacagccacgtcagggacttgggaacgtctgggccaaggagccaccttgtgcagaggcatggagtcatgagagattagccacggtgggaacgtggtgaggacactgggctgagcagagggctcgcaggtggtgctgggcagggagcctgttgacccacccacagagggtttgtctcaggggccggtggcctgactgctgtgcgttaaggaggaaggctctgacagaatggggggacttggagaggggtcattttggaggcctgaaggtggttggggtgtttgactcccatgaaggcagaggtggtacagcgaagtcagagggacacattcctgtgacccactgggcaccagggagatggcaggagcaggagctgagggtagtggtgaggtttctgctggcagagtttggtggttgagtttctgctggctgatttggtggggccagcgagtagacaaggatcccagacgggtgggtgcggggcaaggtggggaatttgaccagatttctcttgaaggtgccctatggggaaacggtgttgtgaaagtaggagggtgaggaacggaggcgactgagggtccacagaggaggatgggccagaggcagaggtgacaggccaggtaggccgagtgagcaggggagccacgtgaggccagtgcgggcgcaccaggcactgggccccatgcagaggggctgccgccccacccccacccaggcctcactgactcctgtgggagccatctaggtacagcaaccacgtggaggatagcgtgaaaagtgacgggacggagcaaagaaagacaccagctcctcgtttgcagaggtttctgcaccgttgtcaccagcatgtggtcatggcctgctccccgggggccattccagccattgatccacattgtcctccagccaaaggaaacaaagcgggaagtggaaagagctggagttacgtgggggcaccttccatcctaggccggcagctggtcaacctcctcagcctcgtcaccgtttaacatcctcccttttgttcttttctccttaatctttatgtttggaaagatttctatagacaaatgtgccgctgcttctccatagccttatctggaacaaaggaaatgtcttttattaccattcatgcaggtataatccgtgaaagacaagcctgttctgccagtcaccaagtcagtccttttccttctgtcttgctcatggaaggctgtcccggccctcacctgactagtggtgcagctcttcagggggtagtgcccatccaattcctggggaaacccaggcgagcctgctggccaggaagcgccagcttgtgtctgattgctaggttaccctgggtgcttcctggatgttcaggcgcccgtgattcccccagcatctgcctcgagcttatgtgcatggagcagcagatccctttgtctgggcagttagattgtctgctaaggaaagtgggtgttggagcaaaagccttgcttcactgctgtactccaacccatcaaaatggaattgtttaaaatgccctcaaaataaaaatagagaccccaagctcttgataaaacagctttctctggagaagctcatcgggctgtgtaaactccaataggaagtatttattcatcatttgtatgtgcacaaatatttatttaatgtcaactgtgaaggctgatgagtaaatcagcaggtagagtccagtaccctggtgcagtgatggggagctagaggtgctgtgcacagtaccctggtgcagtgatggggagctagaggtgctatgcacagtaccctggtgcagtgatggggagctagaggtgctatgcacagtgccctggtgcagtgatggggagcaagaggtgctatgcacggtaccctggtgcagtgatggggagctagaggtgctgtgcacggtaccctggtgcagtgatggggagctagaggtgctgtgcacggtgccctggtgcagtgatggggagctagaggtgctgtgcacagtaccctggtgcagtgatggggagctagaggtgctgtgcacggtaccctggtgcagtgatggggagctagaggtgctgtgcacggtgccctggtgcagtgatggggagctagaggtgctgtgcacggtgccctggtgcagtgatggggagctagaggtgctgtgcacggtgccctggtgcagtgatggggagcaagaggtgctgtgcacggtaccctggtgcagtgatggggagctagaggtgctgtgcacggtaccctggtacagtgatggggagctagaggtgctacgcacagtaccctggtgcagtgatggggagctagaggtgctatgcagcctttggcatggcttcctatccagtgtctggaagagcatccaagaaggatgctttcaacatgataaaagacaagggacatttaacatgatacttgaagaatgaatagaaaatgaccaggcaagacttggaataggacatggagaaaaggtaggaagaaggttctgggcagaaggctggaaagtaggttagaacataatgaggcaaaaggcttaaaagatcctttcttgtggctgaagtgtagactctcagagattatgtctagtgatcaggctggagatcttgcagggactcgtaggtctttctaaagagttttcaaagttagtgggaagacatcaaaggtttctaagcgggagaaggacctattgagttttggagaatggatttggagtgaaacaaggctggaggataagttgggaagttactccaatgatctaagaaatagataagtggtggtggtgatggtggtagtggtggtgatggtggtggtggtgatggtgatggtggtggttatgatggtggtggtggtgatggtggtggtggtggtggtggtgatgatggtggtggtgatggtagagatgatggtgatggtgatggtggtggtggtggtggtgatgatgatggtggtggtgatggtagagatgatggtgatggtgatgatggaagtggtggtgatggtgatgatggtgatggtggtggtggtggcggcgatgatggtggtggtgatggtagagatgatggtgatggtgatgatggaggtggtggtgatggtgatggtggtggtgatggtggtggtggtggtggtgatgatggtggtggtggtggtggtgatgatggtgatggtgatggtagagatgatgatggtggtggtggtgatgatgatggtggtgatggtgatggtggtggtggtggtgatggtagagatgatggtggtggtagtggtggtttggtagtggcttgacctgggtattgatagcacggatagaaagaggtggatggactcagtcaggattgaagaggtagactcaacaggatgcaatgattgatgacataaaaatggaaagggtgaaagacaagaaggtgtcaagggtgattcttgggtttctgttgtccagctgggtgattctcaggtttctgttgtccaaatggttagtgaccccatccatatggattgaggagagaggggagcaagcttaggagggaagacacagaagatgtgcactggacaattcctctctgctgaaaggcctcagacacactgatggattgcttcacatctgggaacaaatgctgtgaagtctctgtgtcctcagcggctccacctggttgcactagggtggaatcatgggaaagggcacaggttatatattcttgccatttattctcacggagaccataatgctcattccatatcaaccgaaaggtagcatttgccatcactctttttggcttttgttttgtttctctgtattttacttgtttttcatcctaacacccttaagggtgagggtaaacaagggctataggaggcgaggccttccagggaaatgccgggcagggaagaaggtcaggtccgcctaaaggtccctcctaccaacatttccctggaaatctttgcatcctacttgagaaggagaggggtagggtgaaactttcactagaccccagatggggccagaactggcctgagtcctgaaatgacatttgttcctccaggacagttctgagagtgttgcaggcatttcggtttgttggatctaaacttgacctgctattcattgctataggatgggaggatggcagcgatatcacttgtactcacagacccagcctagtacgacgccagtgtctttgttagaaactctacagatgtctatgtccagcctgccccagcggcacagggctacccctggtgggattttgtcaaaggggaagacccaccaagtagagcccctgagcccctcctcttcccaggtggccgtctctccttgatccacaccagcggcagtttgtgcagcttcaccagagcttctagcgggaccatgccgccacgagggccactgggagcagagtccctcccatgctcagggctctccagggtctgaagtctgcacttgtatgagaaggagctccaataccaataaaagtctacgtggaaaatgcagaatctgattgcagtagcatttcttaggccttattagcatataaatttaccaggtgtcattttaggacaagagcccgtcactgagaaggaaatgaaatttggagctgcattttccttcattaaaccaagggcccatttttgttttgttttgttttttgttttgttttcttttcttcggttattcattcttttattatcttctgctgtcacatcctccaaaactcctgtgcatatattttcttgcaccttgagatttggcatttcaggaaaaatgcctagcacaataggctgtagtttagagacttgctttgtcattttatatgtccagcagaaattgtcgtaactcccccggatgatcagatgctcccgtgcctctcctgtctctcagaccacacagctattatccctggcattctagttgtgagacaaaaccttaacacaatgtggtgacatttaatttagtgtttctcatttcaaagcccttaaaaatattaattaattcccatgaagccccaggaggcgtattattaatatctgtggcgcctttcatgctagtccattaatgtgccttctctacgcaataggtaagaaaatgaagctaaatccgtttttcgcagccccatgggataagaccttcacagagccagggtcagaaatgatgaatccttaattttattggtgtccctgaataatctaccccgtggccttctgtgtggcgtggaagaacagcactcctgttcaggagcaatctcaggagacagcgaatgattttcctgtggagctgtgacttcagcaatcctagttcgatagctgtgttgaggagagtagaattgagaaaaactgccgcagcagtaatgtaataagtgagatggagcaggaggcacttgacaatttcactagaaaatctcccagcgatctgtgggccctgcagtgaacccagcccctgcagatcgatgggcccgtgctccagggagacagatgtggagatcagcaccgtggcttgttcttattttggggtgccttatctttccgtgcctttgttcttcaccactatgcatgggggatttctgtagccttagcaaccagaaagcagggtggatctgtggaattagactccgaaatctcgagtttagttgacagcgctttttccttccttctgattgcctcgccgtctggcaagctctgcatgtgttcttttctcacctgtatctgcagcccatgactccggaagtctttctgactctgaaaaacatatcctgtgttcactaaggggaagtggttttaatgtgcatgaaaagaggctggcaggcgctcaccccacctggaccctagaccctggagaaggggtgggaagttagcttcagtggacgttcctgataaacgtgagctcaggtggctcacttcccctggcctgactgcagacttgagccaggaacacccattccgccttgtgtgtgagacccaggaggatcaaggagatatcctttagcatccattaaaaaaaaagttttttttgagtcctacctctccatttttgctcttccctacttgagctgtcttaaagcatccctggaggtaggaaaatgcatagaccctccttcccagggccccagtactgccggaggagcctcggtgatggctgcacctctgccctggggcctggagctgggctaacgctttcttggaaaacctctaattgtttctaccaagttagccaggacactttttaaaaagcactttcattaaaaatgcataggtatttgttttaatttacataacggcccagaccaaaatgggatgtggcctgctgcttagactggccattatcacgcctctgattcagagaaaaacctaaatttcatgtttatgcaggtcttatagctgatgcgtttggtttgaaggagcaggtgaactaggtcctctccaggacttggtgcttttttgttgggtgtggagagacatgggcgagatggggctgttgctgctgcgctgatttgaagccatctctccagactgaacccgtcctacgtgtccgccattctttctacctatccacctgaagacggaatgtctagctacctctacttcagacttattttctaatttagaatgtacttacttgagtggatgtggttttggagggcctgtagccaaggtcgtgacagctgaataaaatgtttccttctttgcccccagaactgcgctttcatttatcagctgcccttggtgtgttgtatgggatcagccaacattcaggtatttagaacattaagactcagtggcctggttctgtctcaccaagaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacaaattgatttgtttctttaataattattgtaattactgtcagtaaaaatctgagtatgactcagcaattagttgctggtaactgagtgtgttgtaatgctggggaaaggatataaaacttgtattttgaacagaaaggcacacatgtgggtgagcagtgtttaccaccacagaatttaccgtctacacagaattgagatagctgcacatgaatgtatagtgagcagtgtaagttaattcagagaaagaaaaaattatttcctgctgaaagggttcaagaaggaattttgtaggagagctgggcattgaacaggctcctccagaacatgtgggtcagattggccaccgcatggctggggtcccccatgggccagtgatgcccacctatgggagcaggtgacacgctgcctcccaggccacgcatcgacacccctcctgtcacgctccgtgcttctctgagcacttcctccttccctgtggccctgggctccctgtgggccagccctgtcctggcagagccccctgtgcgtgtcaacgcacatccttcatagatgaaaatggacttgaagatcccgcgttatcagttggttagctctctctcaagtctccttcgtgactctgctttatttttcgagcagcattctggttctgagcgaggagacactgagaggggagaccactctgtggctctaaccccgcctcagaccagggctccgcactgtcctgcagtggcacagggttgctagccttggattagcttttggttctctaatgggctttgcttgcaggtacaaaaatttgggggaacctggaaaaactcttaaatctcctcatctgaaagatattcatacatctactgatgacttccaaagtacaaggtctagaataccaagaggttttatgttgtcataaattagagttttaatgtatataattaggtgaaaccaaatgtgtatcatatacaacagagtaaccgtgttgcaggaattgggcctcgttttcctgttgttttcctcacatctaattctttttctctggaaatgccagggaacctttctttattttctttatttttatttttcagtagagacgagggatctgactatgttgcccaggctggtcttgaactcctggcctcaagtggtccttccaccgtggcctccgaaatgctgggattccaggtgtgagcccccgtgtccggcaggggaacctttcttaagcatgaatggtgtgccctcctcagggtgtgtcctctctgcttcctttctcagtcacatcagcaggtgcttcgtgtgcatctgtgtgcccagcctgggcacagcgggagcccaggccttccttcaaacgcagcctcccctgcacgttccaaacacttactggcatttttcttcaagtgatgatcatggcattggccttacttattttagttgtttttaaaagaaagttttaaaagtttatcaaagtgatgaacatacacatcactttttaaaaacataatccccacccagaggcaaacccttttagctatttgttctagtggcatatgttggtgctgctttgcactgactcatcaactcagggcatcttccctgactgcctggtgtggccccagcactttcacacccgttgttcccctccccaaccccagaaggtcgtagatttactctgtcggttcttctttgttgggagttcaccatgaaaagtactttgcaggaaaagagcaatgatagaactggagtagctcctcgcatgacccacctgtgcccgttttccagcatcctgccacccagccaggtctgtctcctccttggcccgttctcctcactcaggttctctggaagttggcacagttttactaaaataaaatcagcattcatagcattaggactatgtaaacactgttctcaagcaagccaagtcatgtgtacttgggtctgattctggactttgtgtgtgagttccctgggctgctggtctccgtgcccccagcctcgctgtcttaatgagaggccctaggggagcctgcagtgtctggcaaggccaggttgccctcagggctttctgctgccatgattttctggcccttcgtccctgtttgtttttccctgtgaccttcagtagcagcttagctccttggggtatttactgggaatgcattgaatatgtgaattaaacgagcgagagctgacatcttaagaatgttgactcagcccacccaagcagggagcatcttcccatttgttcacgtcttctgtgttttccaggagagctttgaaaatcttccatgtctgtgttttgcacatttcatgttaaacttattcctatgcattcagtctgctctgtggctttcgagatggggttttctttgccatgatgttcctttgtttattatttgtgtatatcaaggctattgattgttctctgtcagttttagattctgctcattcagggttaagggcccaggcaggaggcggagggaggagctttcagcagggcgattccttactcggtctcttcactcttctgccattgctgccatgtgtacattgcaggctccttcatttgagcaaattctctcttccatgctccagatgttttcagaaggaccgcgtacttctgagaaacacttggtaccccagtggcagctgcgtttgccttggtgttgccatgtgacaggcattacttgtttatctcattgttgttcctagtagttctcaatgtttgttgaatgaatatttataaccatcatgtgtggcagttcttatgtagtgttttgatttgtttttttgagaccatctcactctgtcactcaggctggagtacagtgttgtgatcatggttcactgcaacctcaacctcctgggcttaagtgatccttccacctcagctgggactacaggtgtgtgccaccacacctggctaattttttttttttttaattgtagagatggggtctcattctgctgcccaggctgatcttgagctcccgggctcaaccagttctcccaccttggcctcctaagctgctgggattttcggcatgagccagggtgcctggcattacctggttttatagatggagaaactcagagccatgtgtccaggaccacacagctattaactgcaaacccagaggaaagggtaggggatgagttccaagcattccctggagtccgtggtaaatttcttcatttcttctcctgcaacaggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaaggtgggtgtgccttccagcttccttcccgtttctgccaaaagccatgccaattgcggtggtcggagcaggtcctgcccatccgtagcttctgttaagccattgatgtttactgtgtttcaacaaacccaaatgccataactgaacggaccaggtagtcaggcacaaggaggggctgtttctgtggcagaacgtgttcatggaatgactgccttgaagtgtggtgcgtgtggtttatgttccctctgtaagaccagcagttgtttgtaattctccgaggacagacctcgagagtgtctgccttctagtttgaaaaaattgcacaatttctcaatttcgttagaatctttctttaagcatcggtgattttcttagaaaataaagtgttttatatattctaaagggctaattccaagctgccctgcaggtgcaggctctgggcttccctcctcaaggtcagaatcaccagccttttgcaattccgttgcccaggaccagatgaagtgcttgctccccttctgtagctgttgctgtgggtggtgggtgctgactgtcatccccatcctccagggtgtggtgggtgctgactgttgtccccaccctccagggtgtggtgggtgctgactgtctcctcatcctccagggtgtggtgggtgctgactgttgtccccaccctccagggtgtggtgggtgctgactgtctccccatcctccagggtgggaaccttggtctgtctcagagcagccagctatgggtctcactgcgctctgcgtgatgcatgaaaagcagttcttggagggtgcggtggccccatatgtgcctgagcgtgtctatgagggcactgatttggaatccagcaaatccgagtcccagtttcggttgtgctgtcagcctcctgggcttctgcttccttagtgtggacaccgcctcctgccatcatagtgaggactctgactccgtttcttcacacactgaactctcggttcccgcctaccgtcccgggttcgcagctagcattcggcacaggtggtgaagcagtgtgggcccagagcagagacctcgaggaaggcttctgaccctggacactgaggagtagccagcctcggaagttagaaaggtatccacccagctcctcccgcagggcacagggcagtgccatctctccccgtgtgtatctggataccagcttgattttaattcctttcgttaaatattgagtaaattcaaaacgatcgttgtgaaggaagtaggatttacagaagcaggatgtaatgaaccaccaggcgtgcaccacaggcccctggcgtgtctttctcagctgcagtctctcctttccctgccctcccctgtggcgcctggcacagtgaatttgaatttgtccttccctggctctcctctgtggagcccccggtgtgctggctctcaggcacggcgaatccgggagatcgctgctgatacgctgggcggacgctggcgcgctcttccgcagtgcgctttgctcacttggtcggaggctctgcagattcatgccaccgaccccaggggcctgcagccctgcctcttcccacattcgctgtcccctgccgggaccccgcccttctcagtgccttccctgcagatgggcattgggctggttcccatcttgtttctgctgtaaaccgcgtgagtgtttcagctgcccacctttctctccagcactgggtgttgtcacaggttttttttaatgatagactgtggtgtgctctgattttctctgataaccattaagatcgcgcaccctgtgtccgcccgccggctccctgctgctcaaagcgcctatctgctatccacttctctctgcagtgggttgccttttcctatcggtttgagggaattctttgtattccagacagtaatgatttttatgaattgtgtctctcttctcagaatttatgatgtgattttttttcttcatcttcttacactcctgataacttacaaaacttttttttttttttgaaacagggtctctctctgtcacccaggctggagtacagtggcatgatcatggctcactgcaaactctgccttctgggctgaagcattcctcccacctcagcctcccaagtaggtgggactacaggtgtgcaccaccacacctggctaagttttgtatttttgctaatttttgtattttttgtagagccagggtcttgccatgttgcctaggctggtcttgaactcctgagtccaaataatcctcctgcctcagcctcccaaagtgctgggattacagcgtgagccactgcgccccgctcccagttgtgctttttatttgtccttcttgtcttggtgtgctggccgatgccttcagtggagtgaagtggggactgggtggggagcggggagggaggcatctttgtttctcttgtcctcgcagagggagagtttctgtgttcagtgtatgatgtttgccccaggctttttgtaaaacaaaaacaatcaccattatcgaattaagaaagtacaattcttaatttggttttttaaaaaaattgtgactagatgttgatttgcctcccttggttatttgtatgtgtgtgtgtgtgtgtgtgtgtgtgtgtgtgtgtgtgtgttaaagtggtcacagtacttttctcccttaggctggtgctacgttgaatgatactgtatgaccatctcctgttatacacacctttctttttggattaacctgtgttatgatgaatgatctgtttcatgcatggcttattcagtttgcagccattttgtttcatatattaaatctgtgttcgtgagtgagattggacagggattcttctttgtcttgctgtccttgcctaggcggagtaatcaataactgtggccttagaaaataagctgaggaatgttccttctttgtatatatacttgaatagtttttgtgatgtttgaagtatttgttgtctgaatgttgtggaacttacaaagaaagctctctgggtggtattttgtttgtggagagtttttgacttactgatctagcttctttcatggttaaagggtttttctgttagctttgccaactgacttttgcaggaccttgtccatttctactaagcttcccgatgtgttgacataaactggctcacaatacccctttagaaactcaccagtatcgggggtatctgtgagtgaggtgccttcctttgctcttggtgctgggtatatgtgccttctctcttttcttgttgattattcctgtgaggagtttatgtaccttttatcagtcttttcaaagacccagcttttaccattgttgaccctccagaggatggaaggaacagtaggatgaatacctttatactgttcccctgttgccaatttgacactttttttcttgtcccctgaaccatttgaaagatgcagacatcctgacactaagaacgaggatggctttctgtatcaccacattaccgtcaaattgctcaagaaatggaacatcagttctgtgtcatttactatagagtccatgtttgtgttttcccaagtgtttgcaaaatgtgcactaaattagtaggcatttttttacttgttgattttgttgtggacccagaatctaattaaggtccatgcattgcatctgttccttatgcgtttttagttcctcttgcctttcatgttatgacattgactttttaaatgactttttaaaatttaaaaattttgtcttcttttgggaagttaacatatagttatacatcagtcttttttttttttttttgaggttaagtctccctctgtcgccaaggctggagtaacagtggcgtgatcttggctcactgcagcgtccgcctcctgggttcaagcaattcttctgcctcagtctcctgagtagctgggattacaggcgcccgccgccacgcccggctaatatttgtattttcagtagagacggggtttcaccatgttggccaggctggtctcctactcctgacctcaagtgatctgcctgccttggcctcccaaagtgctgggattacaggcgtgagccaccgtgcccagcagtcttttttaaaataatagacatcattttttttaagagcagttttaattttacagaaaaattgagcaagtttattgagttatatacttccttcccctcattttcctctattgttaatatcttgctttggtttgttatgttttttacaattggtaaactgataatgatgtgttataattaatgatgtccatatttacactagggctcactcctagtgatgtacatgctgcagattttgctgaatgtgtgatttcctgcaaccaccgttaggttgccacacagagtagtggtgtccttcaagtcctctgtgcgccccctcatcttctctcccctagcatttggtcttttccagaatgtcctatagttggactcatatagtatgtagccttttcagacaggcttctctgactcagtaatatacgcttaagactcctccgtgtctttttgtggcttgatagctcattttttacaattactgagcaatactctactgtgtgaatgcaacactgcttctttatccattttcctattcaagggcattttggatactctgaacttctgacaattaggaataaagctattattaacgtgtgcaaatttttgtatggatataagctttccattcatttgggtgaatacctgggaatgggtttggtggatgattcggttagagtatgcttagctttataaggaactgtgaagctgtcttccaacatgtctacgccgttttgcattcctgccagcactgaacgagagtatctgttgctccacatgctcatcagcatttgatgttatcagtgtttggattttagccattctggtgggtatgtagtaggatcttattgttatttcattttcaatttcgtaatgatgtgaaattgggcgtctttgcatgttcttatttgccgtgttatatcttctttgatgaggtatctcttcaggttttttgcccattttaagaatcaggttgtttttcttgttgctgagttttaagagttctttccatatttcagatgccagttttttgtttttgtttttgttttgagatggggtttcgctcttgttgcccaggctagagtacaatggcgtgatcttggctcactgcaacctctgcctcctgggttcaagtgattctcctgcctcaacccccgaagtagcagggattacaggcacccgcctccacgcccggctaattttgtattttttttagtacaggctgatctcaacttctgacctcaagtgatccacctgcctcggcctcccaaagtgctgggatcataggcatgagccaccacacccggcctggatgccagttctttatcagatatgtgtttcgcaaatatgtccacccagtttgtggctgcttgttttcttttcctagtagtggatgttcgctttttgacgagtttggaccagtgatcctccaggatgtcccacattctagtttaatttcttcgctttttcacaagtttttgtcaaaccagattaaaaaaaagcatgatcaaaccttgtgctgtccatagtagatgtattttaaatacaaagacatatgaagtttgagagtaaaagaaagggaaacgatatactatgccaatactagtcatagaaaaccagtgtggctctattaatcagagaaaatagactgcaagatgaggagtattattgatgataaagagggccatttcctcatgataaacaggccagttcatgagccaggcacacaccatcctgagtgtgcgtgcgcttaatatcagagtttcaaaggacatgcagcaaaatgaacagaattaacaggaaaagtatgcaaatccataatcatagttggaggttagaagatcttcttttagtaattgatagattaaactgatagttaaaaattatagacaaaattgatagttaaaaaatttttttttgagatggagtctcgctttggttgcccaggctggagtgcagtggcgtgatctcggctcactgcaacctccacctcctgagttcaagctattctcctgcctcagcctcccaaggaggtgggactacaggcgcccaccaccacgcctggctaactgttttgtatttttagtagagatggggtttcaccatgttgactgggctggtcttgaactcctgacctcaggtgatctgccggcctcggcctcctaaagtgctgggattacggatgtgagccaccgtgcctggccctgtaattaaaaactttcttattgagaaaactctaggcatagtatattttttctagtccaaagcaaaagccagtattaatgtaaaagacctagcaatattatcaatcaccccgacttaattaacatttatacagccgtccacacaactgtagaatatacattctcaagtgcatgtggaatgttcaccatatgctgagccataaagatgtctcaataaagtttgaaagattaaaatcatagagtatattctctgttcttgaaattcaaaattatggaatatctggagaagccccagatacttggaaatgaaataccacatgagtcaaagacaaaatcataaaagaaaataaaaaataattcaaacctaaagataatgaaactatgacacccaaatttataggatttaggtgtaacagtgcttatggaaatgtacagctttaaattcttacatagaaagatacattttagaaatatatttaaaatgaaaatctgtttttttgaaacggagtctctcgctctgtcgcccaggctggagtgcagtggtgccatcaccacccactgcaacctttgtctcctggattcaagcaattcccctgcctcagcctcccaagtggctgggattacaggcgtccaccaccgttcccagctatttttgtatttttagtagagatggggtttcgccatgttggccaggctggtctgaaacccctgacgtcaagtgatcctcccaccttggcctcccaaagtgctgggattacaggcgtgagctactgtgctcagcctaaaatctaatattctgccttaaggaaacagaaaatgctgagcaaattaaactcaaagcagaaggaaagaaataacaaacagcagaaatcaataaaatagagtacaggcaacagagacaacatagctaaaatgtgttttttttgaaaggatcagtaaaagttgacgaatctctacgtaggtagatcagtgaagaaagagagaaaacactttatcaacatcagcaatgaaggagaggatatccccacatatcctataagcattaaaaaggtaagggaatattattaattttatatacatttaaatatgtaattaaatggacagatgccttaaaatacaacttaccaaaactgacctaaaatgaaatagaatatctgaatagccctatatcaatcggcttctttccaaggccatgccaggcatttaatccctgtgaggccaggggctttttattttgtttactgctacattccaagctcttaagatagtgtctgttaccctagcaggtgtttggtaattgtcaaccacatgggtgggtagatgaatggatgtttttatttttatgttttttttttttcaattttttatttttccataggttattggggtacaggtggtgtttggttacatgaagaagttctttagtggtaatttgtgagattttgctgcacccttgtagtcttttatccctcgccccctcccacccttctccccaagtccccaaattccattgtatcattcttatgcctttgtgtcctcatagctcagctcccacgtaacagtgaaaatatacgatatttggttttccattcttgagttacttcacttaaaataatagtctccagtctcatccaggtcactgtgaatgctgttaatccattactttttatgactgagtagtattccatcatgtatatataccatattttctttatccactcattgattgatgggcatttgggttggttccatgattttgcaattgcgaattgtgctgctataaacatgcgtgtgcaagtatcttttgtgtataatgacttattttcctctgggtaaatacccagtagtgggattgctggatcaaatggtagttctacttgtagttctttcaggaatctccacactgttttccatagtggctgtaccagtttacattcccaccagcggtgtagaagtgttccctgattaccacatccacaccagcatctactgttttttgatttttttattatggccattcttgcagaggtaaggtggtatctattgcattgtggttttgatttgcatttccctgatcattagtgatgttgagcattttttcatatgtttgttggccatttgtatatcttcttctgataattgtctattcatgtccttagcccaatttttgatgggatttttttttcttgctgatttgtttgagtttgttgtagatttccggatattagtcttttgtcagttgtgtagattgttaagattttctctcactctgtgggttgtctgtttactctgctgactgttccttttgccgtgcaaaaggcctttagttaaattaagtcccagctatttatctttgtttttattgcatttgcttttgggttcttgctcatgagatccttgcctaaaccagtctctagaagggtttttccaatgttatcttctagaatttttatagtttcaggtcttagatttaagtccttgatccatcttgggttgatttttgtataaagtgagagatgaggatccagtttcattctcctacgtgtgacttgccagttatcccagcaccatttgttgtaaagggtgtcttttccccactttatgattttgtttgctttgttgaagatcagttggctgtaagtatttgggtttatttctgagttctctattgtgttccgttggcctatgtgcctgtttttataccagtgccatgctgttttggtgactatggccttatagtatagtatgaaatcaggtaatgtaattcctccagatttgttctttttgcttagtcttgcttcggctatgcaggctgttttttggttccatatgagttttagaattgttttttctaattctgtgaagaatgatggtggtattttgatgggaattgcattgaaatgagtggatatttttactgaaatgtcatctgatcaccagatgtggcatgcacccctctccttgactctttagtcctcctggtgtggtctgtttttctccacagctttttcccagtcttatgtatattgtctctatgtcaccattaaaatgtgagttccaggataacaaggtctttgttctatgaaccgctttatcatgggtacctaaaaccaagcatctcagaacataggaaatggtaattcaatgttcactgcattctacgctaatgtcataaaagcaacagaatgatccctagagccaagtctttcttggttgtattttcccccactgtgttattccattagtttatcctttcataggtttattttgcacatcacgtggcatgccaccggagacaggcgcgtgttcttccagatctagacagccataagctgcactgtagagcatgcagtcctgttgccgagtctttcagccttcagataggctccctccatcaaaacgaagcctgcagcattacagatgatacactgtcggtacacaatgtaagatttaaaaacatttaaacatgctagttttaactatacttttctttttgtttaatcaccatttattctgttgctggttgttttctcagcctcagcagaaaactgaggttcaggccttaagcaaaatccgggctcagattttccccatgcaccgccctcccttgcattcccctgtctgtgtttcaggcaattaggactggcagctgtagccattaagaattcacgtagcggaacgtttatcgggagaaggattaatccactactcgaatactcccaattagcttttagaccctgtctgccttttcttctttgcaaaaggagaaaggtttttcccacttgatacattttttttctctgctttttagagttccattgtgaccagaagctatttccaccctttgctgtgtacctaggcacaaagctacaaggcttttccctgtgtgtacagctcatggtgccctctctaggtaggatgagctttgctccaggttacctgcctttccttaatttactgaacataaagttggagttttatgtggttttgcatttttggtttaggataatttttaattcttcggtggtcttcctgtggtgtttacaacctaacccctaccctctgccaaaatcatcctcaaaggccatttttgtcttgcactatgttctacccttacccctccggacattaaatagggacataaaatggatcttatcatggagagcacagacggaaagcaaagactgttttgttctgattgttggttataagtctagcttaaagccgaattgcatgatgatgtattgtgataatgtagggaaaatattggccccttcagagagagagagagttgtgccagcccagccatggtgggcaggcaaggttggagggggcctcctggagaaggcggtgcttgctcgggctgagtcttacagaagagaacaaaggcaacagttgtccctgagaggggactggaggggatgatctcagaggaagtagatgatataataaaccagcatggtattcattggaaactacaagcagttctgtgctatgggagcctggagcctgaattgggtttcaaaagaaagaaggccagaaagtgttccaggctaaggcatagagcacctcgcagactcttagggatgtgggcttagataaatccttttgatgccgtgtgaagcctggctctggggagaaaagactggctagagaaactccaggtagaaggccgtcgtatacaagaggccagtggcggcaccctgagtcaggctggtggggcgaccctcaggaccttcctaggacaggtggaggttgagttagagggagcaggtgagacctggactgtgaccaggcaccagaagcgagaagaaggagcttgtgggcatttgttctcaggttgtgagtaggccggaggtccatgagtatggggtcgtgagaagtaggggcagacatgctgcgggcggttcccaaaatacagtttctagagccgaagaaggccaagagagtgaaatctggggagcagaagaggatcctggcaggtgatggggaggagaattgggagaaaatggcatgggggaagccgggaagggtacctgtcagcccgggggaacagagatggaattgatatccattattccaaggagtctggccctttagcaagaagagcactttatattccaagtgaagcagtcctgttcaaaataagcagctccccatttctgagaagatgctgagtacatcttctgccagagaactcagaatgtgaatcagaattctcagccctattaaagtggcatcttctcagggctcgttcctgtaaagccccttaagggcacagccttcctttaaactctcagccaggaactgtggtctcatctggatttgccgccgcagctttccctggactaaagatggacttgtgccaccattctcagaggagggcaaaggacaggggtcagcagattcctcctcctcctgaagggggttcttgaatacatatcatccagaagcagggggtcgtggccccgaaaggtcaggagtggggggaagcggtacttgtgaacagacaactcgggagtatacatcaccagtaaaccccagtcccgtaaaatccgtaaggctgcaagcttattgtcattggtggtggtgtttttggtacttcctctgcccttcttttattacagttaaataattattccatgagcaattctaaataaatattatttaataggatttattggttttttgtttttttaattgggattgtcattatcaaatagatgcctcttgtgttggtatacagttaattgttgcttctgttgaaagatggatcatgggccgggcacggtggctcacgcctgtaatcccaacactttgggaggccgaggcgggcggatcacctgaggtcaggagtttgagaccagcatggtgaaaccctgtctctattaaaaataccaaaaaaaaattagccatgcatagtggcgggcacctgtaatcccagctactcaggaggctgagacaggagaatcgcttgaactgggacttggaggttgcagtgagccgagaccgtgccattgcactccagcctggacaacaagagagaaactgtctcaaaaaaaaaaagatggatcataaagcttttgaaatacactattatcagaaaaatacgtgatttttaaaaagtgatatttatgtcagaccacaattatcatttgttaaaattgttactttattcgtcttgagaatctagcggtgtccaagaaaaagttttatggtaaacttgacctttcttttctgagaaattctagcattttgtgtttgcttacagtagtagaaggccattaacaaaaactccatttctttgggagaagtgctggaaatgtttggagtatttctttatgagagcttaaactttaacaaacaaatgatttccttgatgccaagagatacaaaacctgagagtgcagctgcactgacttcgcgggtgccctgcatttaaaaccacggtcatagcgctgcggtgcccatgcttgagtgcgcccagcatcacctgcaggctcacggagccacagactgccaggccctccctgagcctctgcttctgtggccgtgggtggggcctgacgatttggctttcttgggtgtcccacaaaattgctgctgcggccgcttctgctgctgtctgggttgtctgcctttgagaacccctggtatggacagtgtggtgtgagaggcaagcaggatattcatcttatggtttggggtcactctgcttcttacgtgtcgggagagacacttccccgaccccttgttttccatctctaattttagccgtctagggcagaaacagtcccgggtaaacaccaaggcctcgtgggaggcacctaggaggtgaggaggggctacgtctgccgggtctccaagcaggagtgagaaccagctagacaaggggaggcctgggagtgcgagggggctctggtgacaggaagtagtcccctctgacccggtgacaccgtggggagcaggtgatgtggttccagtgctctgtcatcctggggtcagtaggatgaaagatgtcgtagcagcacaggcagcactgtggaaactgttctcacgactgtgagtcattgaggctcctggacgcggcggaagtgcaagcgggaaaaaggatggcaagttgagtaacctcaggggtaagcaaggaggtgtgagaatcactcacttcctcggcagggcctgcacgcacctggtgcaggagcagcagaagccatgctggctcttcctgctgcgtgtgcatctggccctggaaagaggcacacccagcagcgggctctcctggctcacccggggccgtcagggcgctgcagtttgcaggagcatcctttgggctcttacctcagtcggtggggctgggcagctgggtgtctccagcccatcatgctggaacatgctggaagcttcctcagggtactcgggcttattttggtagtcatacacatgaaatgcactttgggggagaaggatgaaatattttggttaatccactgaaaaaatgaatgttgaggaacacagccagctttcctgttatttattaataggcttaagatagccagaaggacatttctgctagaaagttattgccagctgaaaaagaacaagtcttcattattatccaatttggtatatatatatatatttcaggtttttatgaagctaagggcaaaggtcagctgcttcctattccttgtggattgtgctgctgatgggaacttcctttgacttcacaaatacaagggattggaagtgcattctttgttatctcatatgtaagatgaggcttttaacacgattttcttttagttaattttaaaatattttattataaaattcattttttttcaaatggtgcagataagcataaaataaacaataaaagttcttcctttccttccctccaagcctttgtgtggcacgttcttggcatgttgcaaagtgccgtcatcatcatcatcatcattgagtttggaagaggaaatgataagttttatttttcccttctcaaatttttgaatttgaggtgtcacaggcaatcaaatgaaaataaccaactctctgtagaggtggtagttgcagctgaacatttttgggacttcaatgtttaggcagtatttaaaaccagggagttatatttgattgcctgggagaagatgtggaataagaagaatggaataggcccctgacgataagtttttaaggggagggtggaagggaggggtcccaagctgggaaactttggaagaatgagctgaggcagccggagacctggggagagagtgtgtgtttgaggggagacggcgcatagatgtcaggtggggcaggaatggaagagaccatgggatgcagcatgtgaagaggtgactatgtgttcagtaatttctggagagcagttaggatcaaaactaggtttgcatttttaaaaaacaatttgaaataattttaaatgtacacgagagttgcagaggcagcacagagagttcctgtgtgtccttcatccagctacccagtgtcaacctcttacatgacctcagcacagcgatcaaatctaggaaacatatgttgttacagcactgccaaccacacacagcctccttggtgccagcagccttgccgctgtaatcctctgtatgtcttgtggtccagcccaggcccccacccacattggctgccttgtcctctggtcctcccagcctgggatggttcctcagctgttcttgtctttcatgaccatgacattgtaagatgctgctcaggtgttttggaggatgtccctcactttgggtttgtctgatgtgttctcatgatgagattgaggatcaaagttttgggaagaataatgcagatgggttattctcagtgcatcaggtttgggggtgcgtggtgtgtgtgattcttattactgcagataccaaccttgatcactaggctgaagtggtgccttgtgtgtttctccaatgtgaagttgttattttctttataattcataagcatttgaaggagatactttgagagtatgcagatatcctgtttctccttaaactgccatgccctaattctaacattcatgtgtaattactatcctggtgttctaatggtggtgctgtacctccctatttccttccacgtttagtaactggaattcttctgtatgaaagaattgttgcttctcttgttgtttatttacttggttgtttgtttatatccatatggagccactaatatttattttacttcttgggttataatccattattattatcattatttattttgttactgaaattgtttcaactttgaccactgacacaccttctagcattttctctaccacagccctggatcaaccatttttccaaggatctttggcttttttgagagtgggatttagaaaccaagatgtggcctctttgtgtgctcgttactactggagcattagtgttactaggcctaggccctctccgtggacttagctaagtgatgcatttgtgtgtagtaagctgtaaacacatgcatattgatttgcgtatctatgtacaggtgtggaaactagattttaatgactaaacaggaggtaagggactagggactggaatagactaatctttccagaagtttggtgatactactgaataacactgttttttctagctttctctgtaatacaatttttgcaataaatacatagagagcatgtgattagaggagcctgtctgttggggagacctcgaagaaagaacaaggctaagcagggatgtttagtttctgcaagaggtaacttatgtttgtagataggagaaagggggttgctgaagaaagtataaatcagtggagtaaaggatgagaaatgggaaggtatgagaagattaattcaggacagagatacagcatttgacttggcaagcccaagcactcttctctgagacgtgggagggaaggagaggtgaatacaaatgtggtggagctttgaagctggacatgagagctggttccccttggagcctgtctcctgttaagtgagaagccaggccatgtcctgagaggtgggggccatgagtgccaggatggaagggtcaggagagaggagacatggcaacccaccccttcctcatgtttactgcctggcatagttggcatttttctttatgttgaggaaaatgctgctatgatctgattagtaggtgctaaataccccagtttgtataaagtaggatggtatctttgcagggctaatgaaatggccaaatcaggtttgggtaaggccacctggagatccatgtccttcagctgatggcagtcttcctgtgtatcccagctatccacagagatgcttgcgagttctaccatcgcaacagcggcgaggccaggttctcccatcccaacagtggtgaggccagaaatttccaggctcatcacatctacctgctcagcctgtggtgggttggagttggggttgggacaccccacctgcccttccagagggcgactgtctgcacctgcccagtgtgccccccgttccctcctctgcagtgtcagagctgctgtgcctggatctgaggaggggccgtgggagaagaagccgcccccacgacacttgcgcttgccttttcagctggagcacggggtggcggcaccgtgtcgttctgcccacctcacccactgggatgcaaacttgctgaggccagggcttcttcctgccatgccttgccaccacgccccttgcctcccctgggacatgccgttctcttctttgtactcatctgtttggtatgtgaggggttttgcgttttgtcttctgctctgtaatttaaagggataaaacgctcacatttaacttaagccaaaacccagtttcagtctttccaccagaaatccctgagatgtagaattgtgggaagctccttggaggctggcgggctgctgggctgcccctctgtgggaagacagcctgcaggcttcagtgggctgggctctcccggccatggctgccttggtggctaactcaggctgcggcgacagactggtgaggcaggcggactcttcccctgatgtttaatataacctgacagataaagtggattgtaatgaagaaattatctaaaacccatttctatttctttgtttgaaaagaaaacatggccttgaatatgattcttggagaaaaagaagagacgctttgattaggaattattctctgtacttttagttttggatcaagaagaaatgaaaaccattggccacaagctcttgagtgttccaagcagccttccgtgtatacagggggcttttcaattctgggctggtgtgggttggtgcagtcaggatgacagaggaatattccacaggacaacgaggagtgactctactgtgggcgttgtttctgcccctgcagccggggctgtgaggctgcaggctgccctttgctggtttgcaggggccataattctggcctggagcttgacaaacgacccaggacctctgagatgggaaatgaggtctgcatcccgtgttctaatcaggattcgctatcaaaggtcattttccacactgtggcttaatagagttggttttatattccctgagggatacagacttccaaattgttgcagtctcactaactgtaatgtatacagctcatgtttgaaaggaaatcgcctctcctccaaggcagcggttctcaaccagggaaacttttcccctcaggggacactgggacatttggcaatgtccagcaacctggagattgtcacatctaggtgtgggggtggctgggtggtgctgcggaagattgtgtggtgcacagggcagccccacaaggagcggcccggccccaaatggccctggtgctgagagggacagacgccgctcacagagaagcgaccacagaggcccacatccaagcaggcttcccagagcaggcggggctgggaaagctgttctgtggcgcagcatcccagtggctgttacggggtgaaagcccctcttagaatttaaagtcctagagcagagaccaactggggccatccatggccctgtgccgtgctgcctcctggacgcacgctaggaggtggagatggtccagccccagcaggactgggccacgaggaccctgccggtaacctggtgctcgccgcccacagatcacggggcgtggagggagagactgccagtgctgtcctagtgcagcagtacctcatggttatgacggatcatcttcctgaactttgcatctcagaatttaaaatggagattttgattttgattttggcaaatgtggaaaatagatttcagctcaaaaagcaagacctgagaacatggtgtgttaaaatatctttcatttcatgccactttgcagccctgggaccctcggggttgtacctagaaggtagtaaagatgacagcagcccccgtttcactgatggtggcgcagaggacgttgtgaggtggctgtagggtcaggtggctgtagggtcagggctgggcaagttgtattcagatgctgttcgctaagcccagaacattataggaggtaaataaatagcacgcagtgttctgggggtaaaaagatacacccatgtcccaggctgctgccaaaatcctttctcctgtcagcgtggggggtgatcctgcccaattaaaggacgtcttttggcccttctttcccttggcagcagcatggaagtgggtgggggaggagaggagcatgcttcccccaacccctggggacctgtgagcgcagcctgcaagctccggctccaggaggaagcgtgctcaagtgcacctctgaccacgtcacgctgcgagaacgtgggcgctacacctccgaccacatcgtgctccgagaacgtggacgctgcacctctgaccacgtcacgctccgagaacatggacgctgcacctctgaccacttcctgctccgagaacgtgaactctgcacctctgaccacgtcacgccccgagaacgtggacactgcacctctgaccacatcatgctccgagaacgtggacgctgcacctctgaccacatcatgctccgagaacgtggacgctgcacctctgaccgcatcatgctccgagaacgtggacgctgcacctctgatcatgtcacactccaagatcatggacattgcacttctgatcatgtcatgctctgagaacatggacgctgcacctctgatcatgtcacgcttcaagaacgtgaacactgcacctctgaccacgtcacgccccgagaacgtggacgctgcacctctgaccacatcatgctctgagaacgtggacgctgcacctctgatcatgtcacactccaagatcatggacattgcacttctgatcatgtcatgctccaagaacgtggacgctgcacctctgaccatgtcgcgctggccagaatttggctgcaggacagacttcactggaaaggaaactgggccatgtgctcagctacaactgctttagaagagagagaaaatcagatattagcctagcagtctctaccacactggcatttagataattttcagcttttttttttaccagtcaaaacatctcatgtacaaatgcaagtatttctataggatggatatctagaagtagtcagaaggaatgtgcctttaaaatttttgttaagtacttcccaattgccttccatacaagcttcattaatttacattcccaccattgatggatgagtgccctgcatcctcccacaatggggcattattcacattttatcctgctttccactttgctgaataaaaacagaatggatgaatgaatggatgggcggatggatggatggatgaatggatggatggatcgataggtagatagatagattctcattgtaatttgcatttctaataaagagcatgaaacttagaatcatttttgattcatttttcttctgtgaattgcctgtttgtatgttttgcctgtttgttttcgttttgtcccttgttgatctgcagcagaagtttatatagacacatctaaaaaattctctgtcatgtactgtgtacctcctttcttctaaaattgctagtcattgatatgtctttattagaattatagatttttttatcttactgtatcagtcagtctcaagacttattaggttttgtgacttgcttaattaaggcctttcatatgccaaaataaatgaaaattttcctgtgcttttacatttaggttttcagtccactctggggtgtgtgtgtgtgtgtgtgtgtgtgtaatctcagatagcaaaataccaaatggctggttagagtttccagcatcagttattgaattgttaattccttctttgcagatttaaaatgctgtcctcattagagttacgtatgtgggtctatttctggactctctcttttctgttgatttgtttgtctccctcactaataccatcctgtaattaccatagatttatagtatctttaatatctggcagtgtgagtccctattcattattctttattaatttttttttgctcttgtgcttttttttttctctgtactatataatcatcttgttaaattccgtgaatggaaaaaacccagaaggtattttgattaggcttggactgactttctggattcattaggcaagaattgacatctctagatccttcagtgggtttatttacagagagcatttccaggtgttctattatagagcagtgattataaacagtccaccaaacgcggacagttttaacaacatgtttggcagagcacaggtagaatggggtcctgcccacgatgatgtacgtgtctccacacaccccccacacatctgcgtcgttggtatactgtatcatcatgtctgagatataacttacgtctgagatgtagctgatgtctgaaatgtaacttttgtctgcttctttgctgtgcacggacaaagcttctgcaggcttcctgcacgccatacttccccaggctttgctggatctggccttctgtccctttcctcttgagttataaacaatcctgtaggcagtaccagcggcaggatatgtggcttagctgctaagaaataaactcacttttactgtgactttgatttttgccaatttctgggaatttgatttctgccacagcttcactacttacactcttgatgtccaaggaaaggtaaataatgaacgtgttctgtggagaagaattccttaaaaatgttagctttgcgttcggattgtaagtgtttctcaagtgagatgagaacattctcctctgcatttaccagaatcactagtgtctgttcaggcgctgaacagtatggtgtgttctgaaaaatgtttcactcagcagattagtgttactaggttattgttctgtgactgaaataaatttatacagccaaacccacttataccccttaagtatgatctttcaaaagtcatctcaatgacaaagtgcttatggacctctctgaaattaaagggacagtggcatgcaaatttgaggacccggccaactcttagagctcccctcccttgtaaatgatgtgtgtgttgtgttatataaacccagagatgtgacagagttaaaggacaaatggagacacggagtgaagagcacgtgtgtgagacagctgtgggtccatggagggaggccccgcggcgggaactgaggcagccatggggtacatgagggaagccccacagtgggaactgagacagctctggttccatggagggaggtcccgcagtgaaaactgagacaagtttaaggagttgaccagcagctgaacccagcggcagctgcggaggagcctggggctagggatgatgactttggcagccacctggtgtgggcgctactggagtaaagcagcatcagaggagatgtggagaaattcagtttgatggtttttgttttttgagactgagtctcgctctgttgcccaggctggagtgcagtggcgcaatcttggctcactgtaaccttcgcctcccgggttcaggtgattctcctgcctcagcctcccaagtagctgggtttacaggtgcccttcaccatgtctggctaattttgtatttttagtagagactgggttttaccatgttggccaggctggtcttgaactcctgacctcaggtgatccacccatctcagcctcccaaagtgctgagattcaggtgtgagccattgcgcctggccagtttgctgttttttatagttttgtataaaggctaactcagcgtctctccagccaccaggctcaatgtgtgtgccttttgtaacggtgcagtactcaccagcagcccatattcctgagacgcacatgtaacgagcgcactttgtgtgttttctagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtgagcgctctggtgcttggagagcggtgctgggtttggttttgttttccctgggggtggggtttgggtggggaggttgggaggtgttggacatcctctgaatggagcagggctcagaatgccaagggcaggatggcatattcaatgctgttgagctagggaggcactcagcacactttatttttgaaacataatcttgttctgttgcccaggctggagtgctgtggtgccgtctccagtcactgcaatgtctgtcacctgagcccaagcaatcttcccttctcagcctcctgagtagctgagactacaggtgcacgccacgccaccatgcctagctaatttttgtagtttttgtagaggtggtgtttcgccatgtttctcagcctggtctcaaactcctgggctcaagcaacgcgtgtgcctcagcctgcaaagttctgggattacaggcttgagcactgagcccggcccagtacaaacctacagacttatttttacatctcattttactcagtgtcatttttaatccaaacattaattgataacattcatagggtcgatttgtgccccagcagtctctgcctccaagataaatgtgaaaataaagcagacacatttattttaggagaaatggacccacagcttcagttccaccagtgcctttgttcctgccccggtttctttttctgttgtgttaaaaaaaaaaaaatccccgaaaaccactaagctaaaatgatagaaaacaaacgaaaacagctactgttgtagcgcccacttcaaaaagcggaaagcctgtgcaccgctctgctaatgaagagacattttgcttggttgttttaattaatatttgatgtttgaattaaacagtgaattctgaggacaaattgaagaggcagtttcgattaagaggcctccatcttgtggcctgcacaagagtgtcagaatgaaatattctgcagcctcaagggggtcatgagttctactggttgcagtataggaaattctcaatttaggagcaaaaatgatcttgagtatgtttcctcaagcctttttgaatatattcaattttaatgtattatgttttcacatttcatcatagaaaaatgctgaaacaatcagtaacaaaatttgaaattctgtttggtagattttcacattaacatgtgtacagttgaatattttataattattaattctttatgtggaacaccgcaaaagagtgactgataagtataatgtggtttatccatgaaaaaggatccacatgcaacaagtttgtttgttttgttttctatgataagggaaagaaagatcaaggtttgtatcatcagatttttcccttgctttcaggcatttcatcttggtttacccaggggataggttatctaatgagcattaagaaactcaaagcattgagaggtaatttatttttccttgcatcaagtaataaatatcgcaaaaaaaaggtgatttttttacatttataatatgtaaataaaaatgccaaagaatcctgcctgagttctacaccagatttatgggctggagagtggttaagggaaagaccaatacatcagcctcagttaattaaaacatgttaaatagagacccgctcccctttcagcagaagaccagcacctccagctcatgcataataccaaatgcttgcattccagcgctttgagcatgtgctccggcagtgctgtgtgtgctctctgtgtgttgccagggattaatcagcctaagacactgttcatttcatcaagtgtaacagaaaagattcccatgcatcttttttaggaaaaaaaaatgtttgactcattccacatgaaagagatcagatgaaaaatatgttaactgagttggcgaatagatggcaaggcaatgcgataccgtatgtctttaattagctctgatttttatcttcgttctttaattacaatgtagatcagtcttgtgtgtttctattacacttactattattggctattgttcacttggtctcttataaaaacagtggaaattaaaatgataaaattagctcctagctaatagcttaatgttcattttagtaatttcactatctgctagagaaacagcaatcctgtgtagcctgttagggtttttcttttaaaatattctttgcctctttacagctggtcaaattctttgtaaatttacaatatgttttaatactttttattgtataacatgtgagctgaaagaaattgacaggtgaatgatttgttccagggtttaaaaaataaacaattgattaaatataatgcaagaaaatggttatttggaccagaaagcctccaaataataaacattaacacaaatatgagtgacataaattttaagagatggtgatcagctttcatattcttagtggcacagtgcttgtcctgggaccaggaggtttatttattgtttacttctctctcagaggagtgctgtaggtagagtagaagacgacttcatcaaagcacagatacagtattgcacacacttcaaaccatcagagccggaaaatgacatatctgtcactcagtaatccttcttatatttttattgtgtcatatttctttgtaatttaaaaattaaggataatattcaagtctctccgctttcagtcttcttttataaataagtatattttaccaaattagtatatgccatggtttgaaaaatcaaataatacagaaggtttatgatgaataaagtagtccctggccccacgctttctctgctgagactctatgaccaaaggcacctccttcccctgtttccatttctagttcttctggagggtgtctccttccctgtagatgacatgctgagaccactgcttcttgatttgtcgtttttagattatcagtgggctttgtcttagggtacaaaccaagaacagagctgccattaagttctgtttaaagaagggagaaacgatgtggaagcctgttagcaaagaagtcaattatgtgtagattacatgctggtttaaattcctatgtgttatttgtattcagtagtgaattctaaagagaaaattctagattgaagaggctgcgtcactcacgacgccttcttgcgttccctcttattcactctattgggtttctttatactttgtaaactttgtggtttcaagtaatatccttatgcttttatttctagttttatcagtaatagctcatttcttccattttcaaggctcttagcttccttgtactttcttctgccttttttcttttacagcttctgttatctgcactttctgtgattgtctttcgttctctgaccacgattaacacctctgtgcttgagtggagattgattctataggaagacaagcattaaaccttgtacctgattatgaccacataaatattgctcgctcagtggctagagtactgtgatttccatttttataactgttttcgtttgtttgcttttcctggacatttcctcttttcttcttgaattacctatcgttaccacttcctccactgatagatccacaaggagagcggagagcacagaaggcgccctctcccctcacatcttccaagctctcctgcctcgctcagccgatcgtgcctgtggcctgctccccggcgtcagctggctcccctttgtaattctccaggatccgtccctgtgtctagatcccacttcttcccctctctcgattttctcctttgttctcctaggggaaatcctcaagcactgccctaagaaaggatgtttggcagtctgagaccatcagtatttgaagcagtggaagtaatgaaaaatctcattactgggttttaatcaaatagcagtttgtctttttcactaataaggtctctgaggcaaatgatgacttttcagcagtgccactggggaccaggcatccttagccgactggctttatcctcatgtttgcaatatgcccaccacatctgcaggtgtttcatctgcttgggaggcaggaggaaatggggaaggggcagtgctggccacagctgtctctttataaggaagaacagcccgccctctgtatctgtggcttccacatccttggagtcaactaactgtggctccaagacattcggggaaaaaaaattgcattgtactggacatgtacacttcttctcaccattgttccctaaacaatatagtataacaactacgtttacagcattcacatggtagtagatgttataagtagagatgatttgaagcacaccaaagtctgtgtgtgggttatatgcaagcaccacaccattttatatctgtgcattggcagattttggcatccatgggggtctaggaaccaatgccctgtggatattgagggatgactgcaacaagcagacttcgctttagaccgagttggccagagccaggtcacgtagcaccccaggtgtggttgaggggtgactaaagggagtggacttgggggtggctgtgagatgatccaatgaggaccatcagccacattacctgggtaatgtcatcattctaaccacatccattatcgatagtgtagatatggaattttaggcaattttcactcttccagtggtagccctgttactccttgcagtggatgagtagatgttcttgataagtctgccacctccatccagataaatgccataagaggaatatttatagtcatcgtacacagtatatgtattgactgagttggagagagagaaaaaaagagaattcaaatgttttttaacaacttttatctggatactaaatccttagcctgtaaactagaaaggaaggtgaagtcttaaagaaacagatgctcttggaaacggagcccatgaagtcttgtccgtcagtttcttctagaggatatttctcaagggcagtcacagctcaccgtcactgaagacggcagtcaagcccggagtcaaatctaggcgagtttctcctctttttaatgggaggccagtagcgagttgggcaggcggtaaagataataatgcctttcttctgctgggacagcacgggctccactgccccagtaagtcttgttctgcacatagccatctgcttttggtttagggctggagcataggcaagtttttggtgggagccatggaaatagcctgagaatgacttcctggagagcaggttgctgtgtgtcagaagagtcttgtatgaaagttcagccctggccggtgcggtggctcacgcctgtaatcccagcactttggaaggccaaggtgggcagatggcttgagttcaggagttcaagaccagcctgggcagcatagcgaaaccccatctctacaaaaaatacaaaagttagccagctgtagtggcacgcatgtgtcatcccagctactctggagaccaaggtggaagggtcgcttgagctcagagctggaggctgcagtgagccgtgattgtgccactgcacctcagcctaggcaatagagtgagaccccatctcttaaaaaaaaaaaaagttcagcccatggatcatgggcacaattcacttctccactattcccccgcactctgcaaggcttttctcaggatgcttccgagtaactcgtgtttgtgtggtgtctctaaacacaattgtgtggtccagtcctgccacctgtagcagtacactcccaaagcacagaaacctgtccgacggtcactcactgccacagcgagaagcttgcttgggtccacagcctccccaaggctgcagtgacttaaccgccccccgcccctaccaatgtgaaaacctatacttaaactgataggtgatacattggcctcctgcactgatccccgtagctaaattttatgtcaaataaatattgtaattctgccaaaaatgactaacgtctagaatcttcaagtttcctcaaaaatattaaatgcatatctcacagatctaaagtactcatgttctgaaatcttcttcatttctttgctactcttgtagacaggcacactgcttggctggcatggaattctgcagcaaaaggcagttctcctgctgaaggttgtggttgtagtgattgctgaataccatcagttagttctttgggtacctctcaacaggtgtgtttcttaatcactgtttcctaaattggaatttgtgtgtgtgagtttgcaaatcttctccacggactcaccgtcgtcatggcatttgtgattcagaggagggatctgcggtgccgattccacaggagctcaggctcgcctgtatttctctttcaagcaatgattttcataagtgctttcccctgtaatctcatagttttgtcatttgtaggcagtagggacgtgagctgacatgtgttaggtcacaactttattaattttcaagtgatattaatttttaggtttgaagaagatgctttccccttttctaagttgtctctgtttcctccagcataattttttttcctttggttaatttagattattctctgtcatactggaggtatgtggtgattttattgtttgtcatatttaagaatgaagagaagctgcccatcactgcgtgtctgtgacaggaggcgttggctagagggccttgctcgatgggaagtagggggcgctggctgctgcgctggggactcatggatgcccccatgccgaggtctttatttctctgggctctaaatgactacaccagctgcctttaattttccccagatatgtcagtaactctctttagaggaaaaaaacccaccaccagcctgagtgctttccggcaggggggcggtggtggaggatcattgcagaacacctggcttcaggcacacaggtgagacgccggctgtcctgatggcaggtcttcaggtaatctgtgccttccagcccgcaccactccaggcttgggcatgggggctgccttccacttcccttctctgcatgtgctctggacactttcagttcctcttttttaacaaaagttggccaaagtcagttttgcgtaccttatactttatttatagtaagctgtaagaacccatacttgtgaaggttttcaaaacattagaatatctgctccctggtgttaagaaatgtgtaatatagttgaagcacatatattcattctttctctctctttttctcccccgcccccccgccacactcactccaccaccaccacaatgaccaaggagaagtgcatttttcatttagcagaaatgctgccatttccactgtctatagcagaaggggagttcgtccaaaacatacagtagaaacccctttaattggaatccacagaacggccatccccaaagccccgctggggagaatgaagccactgtgagaggttaagagggtgggggggcagggctggcccttggagtgggctggcgagctgacttgccaaccagaaaggaaataggtcacgggagaaatggggggaaacacaggcccatggaggatgaggtccacgcctgccagtgggtgctgggagggcagccccagggggagcaggcagcaggagatgcccagcccggccccgtgtacctggcaggcctcagcctgtggacaccctcgcctttggtttgtgtgacatttcacagttggtgggacatttgtgccgtttcatccatctttagtctgcgcagctgagctgaatgtggccgccaaagcttttgctgcttctctgtgcccatgcaccatccctttctgtggtttgcacggggagataaaggtcttttttgttggcacctttcgtaactccgagtcctagaatttggaggcttcagtaaaaagaaaagtgatttctctgcataaaaaatttaagaacccttaccgctgatgaccttaaatgaatttcacagacacgtgtcattagcacaggcagcttccagggtgcaactgaagttcccctttcttcacaaatgcttcccccagcctgaaatcttccttggctgaccacatacggcaatctcctacacagcggccttgacaatcatgtgttgtcttgtagcctctcttctactgtcataagcttactttacatttgttatgtaaacctgtcaagaatgcctcacgttaaattgatgctcaggaaggatctatagatttggcttgataaatacatatttgaataaactacctttagttgtcttctttagatgtatccatgatgcattaaatatatttgatcttcaattgatttgtatgaaatgtgagaagaaacaaagaaaacttgattagccataattcatgaaaacgatacactgtttgcagttgtcataaaactgggagctttcccaaaaattcttagagtttaaccttttttttgtttctaatttcatctattttaaagtattgtctgaaattgcttgatattctggaccacagatgatggccagcaccatgggttgcagactggggcactgtgatcccagcaggacccatctgcctggccctgcttgctgtcgcgggaacacctctgccgccaccacggaggccgaggggctcgccccgccccgacgcggaggcagatgtctttcacaaaggatcctggtggcacagggcagtggagtttctggctgaaggtggagcctcatgagaggagaggggcaagtgggaagtaagtgctttcactgaacactgaggtcagaaacacggaagaggtgttcattctcacccatcctctccagcatcacacgataagtccgtctgcgcagaaggcaagggcaggaaacaggcatagagatcagaaaagaagttaggccatcttttcttgaagtgatcacctgtgttgaagtgtcagctgttaagtatcacagtgggatttacaggatactccctccagcagcagccaatacacacacttttccagcgtccatgcggcattcatcaaggtcggtcacatcctgggtcataaaataaacctcaacaagttttaaacagcacagcgtgtgttctttaaccacaagagaatcagctacacgtcaataaacacgagaaaaaactgtgaaaaaaattaaacaacgtatttctaaataatgggtcagaagcctcaagggaaattaaaaaaaaatacatagagttagatgaaaatgaatatacaacatatctgtatttataggatgcagataaatcagtattgaaagagaaatttatagcactaaaatcttatgttagaaaagaggaaagatgacaaattattgatataaattcctacttcaagaaattggaagagtaaaataaactgaaagcagtcagaagaaaggaaataataacagaaatcattaaaattgaaaacagaaaaacaatggagaaatattaaaagctgattctcagaaaaaaaatcaataaaatggatacattcctagcaatactaacaaaatagaaaaatcaagagggagatggaaaaacctctacagatcctgcagccatttaaataataatgaacaactttacactcttaaattcagcaactgagaggaaatggaccaattcctcgaaaacccccagctaccaaaatccaaccaattgaatattctgagtattatctgttcagcaatagataatctgaatagtcatagaatcatgaaagaaattgaatttgtcatttaaaattgtctgaaacataaatctgcaggcatacatggtttcactggagactattgccaaatatttaaaaagaagaagcagaacaccggttttgtacaagctcttccagaagatagaagggttgggaacacatttcaactcattttatgaggccattattatcctaatgccaaaaccagacacaccgttcaaaaaaaataaaaaacagcaaaccaatatctgtcacaaacttagatgccaaaatcctcaaaacaataatagcaaatcagttctagcaatttataaaaggaattatacgctgtgacttagtgagtttttttacgggtgtagaagtctagttcaatgtttaaaaattaattaatgtacttcataccaacagactaaagatgaaaaatcatacgattttaccaattgatgcagaaaactctttcatgcgagagaaaacaaacaaaaaaaaaactttcagtgaactaagaatagagaagaacttcaatttgattttttaaaaaatctgtaaaaacctaacagccgtccttttacttactggtaaaagactgaatgtttcccccttaagattggaagcaaggcaaggatatccattcttatcactgttattcaacagaagtactggaagttctagccagtgcaataagacaagaaaaagacatcattggttatcagggaaacgcaaatcaaaactacagtgaggtgctacctcgcgccactagggtggcagcaataaaacagatgggtaataacaagtgttgacgaggatgtggagagattggaatccttgcacactgctggtgggaatgtaaaatggtacggctgcttcagaagatagtctggcaaggttctcaagatgtgaaactgagggtctccccgtgacccagcaggagagtggcatgcactctagaatagcgcttggcccacactgggcactcagctgacccctgctggcttggctaatgagcagagtaaaaacactcctccctggcagtgtgggggccttccgagtggagggtggtgctggtgtgggggccctccaggtggagggcagtgcaggaggccatggcaggcagtggcagtgcttggactaaggtggtagatgttggcaaggcaattgtttgcatctggggttcgttgtgaaggaagagtgattcgctctggatcagatggaggacttaggcaaaaggagttaaaggcaacaccagtgttttggcctgggtggaatggagcagctgtctcccgagccaggaggaccatgaggctggagggtggatggaggtcttggggtgcaggacacaagagctctgctcaggcaatgtggggtgtggggtcctatcagagatgtttgttcagcatctcctgtaaattaggaagggtgacagggcatacagcagcacgcaagtggacaaaccctggctctactttcctgagaatgcatcagaaggtggtcggtgtcatcctagaacagacaatggctgaagccacgggatggtgacgagcccccatgtggttcgtgtggctggagaggagaggccagtcgaggcctgcgttcggtggtgtgtgtagagtctgggaaaaggagaggcactgacagaccagaccagagaagtagccaggcagttggagggtaaccaggcactcgtggcatcaggaagtcaggaaaagcctcaggaaagccttctagaagtagggacagttagctgattgctgtgctgttgagcggctcacacgaggaggactgaggatggaccgttgtatttgtgcacacggggccattgctggatttaacaaaagcagtgtcaacgcagggtggtgggctctcatgtgattctaaactgttcaagagagggtgggcgatgccatgtggaagctcctgagggaggtttgttttcgtcacatggacattatgagagcatgtgtttgtgctaatgggagtaacctggcagagagggaaaagctgatgtgtgggagggagagagagctcctgagggcggcccttaagtaggtgtgaagggaacaggatccattacacaaggggaggagctggctggaggcggagcatcgacggtggtcattccagaaggggatggcagcacatgcatgcagaggccaggtttggaggaaggatgcagacgcacagcacaatcaagtttaggaggagcaggtacacacacacacacacgtatataagcacatgcacatacagacatgtacacatacacatgcacatagacaacacatgcacacatgtacacgtatactcacctacatttacatacatgtatgcacacacatagacatatatgcatatagacatgcatagatgccacacacatacacacgcacatatacatacatgtccacacatataaacacatgcacatacacatacagccatatacacagagacacacatagacaccatagacacacccacacacatacacatgcatgtgcgcacacatacatgcacatatagacacgcacatgtatacatgtgcatacacacatgcacacgcctatatacacatatatacatgcccacctatacatacataaacatacacatatacatgtgcacacagaaacatggacatatacacacatgcacacatacacacaggtacatgctcatacatgcacatctacacactcacctatacacacacacacacacagcttttggtgccatgccgcagcacattcctagtgcttcacatatgttcctttctaattggtgtttgttttagaaggtggagtgagtacacgtgtctggatccagccttattagattgtctttgcgcactgggaataacacccactttatgctcagctcttactagtgtctccagctttccctctcctccttgttaacagaattggaacccttcctgtcttcccgtctctctcctgaaattagccaaggctctctctcttatgactcagttcattagagaagtaagcagaaacacagcagctgatgatgaacaaaatgtttccgggggtgaaggcacccatctggcagggggcagggcgctcttgcaggttccgccgtgcagagaagaagccacaaggaccgagggaggcctgaaggagatgtctaacctgagccgtagaacgtaagaagttgccagcataaagacaggtaggaaaggcatgtcagtgacagaggcaggagaacacgtgacccacttgtgtggggagctccagcagcgcgttcggagtgctgggcattgccaggtctgaaagaggtcatcagttcttgggaaaggtgcctgcgtgggctagaaatcatggaacaaatcataaagccaagtagtaatttaaacccagatgctactttaattaactcactttgctactttgccctcggcagcaagggttgagggcacagccctggctactagcacagccctggctactagcactgtcctggctacgagcacagccctggctactagcagagccctggctactagcactctcctggttactagcagagccctggctactagcacagccctggctactagcagagccctggctactagcacagccctggttactagcagagccctggctactagcacagccctggctactagcactgtcctggttacgagcacagccctggttactagcagagccctggttactagcacagccctggctactagcacagccctggctactagcactgtcctggttatgagcacagccctggttactagcacagccctggttactagcacagccctggttactagcacagccctggctactagcactgtcctggttacgagcacagccctggttactagcacagccctggttactagcacagccctggctactagcactatcctggttactagcacagccctggttactagcactatcctggctactagcacagccctggttactagcactgtcctggctactagcacagccctggttactagcactgtcctggctactagcacagccctggttactagcactgtcctggctactagcacagccctggttactagcacagccctggctactagcacagccctggctactagcactgtcctggttacgagcacagccctggttacgagcactgtcctggctactagcacagccctggctactagcacagccctggctactagcactgtcctggttactagcacagccctggttactagcacagccctggctactagcactgtcctggttacgagcacagccctggctactagcacagccctggctactagcactgtcctggttacgagcacagccctggctactagcactgtcctggttactagcacagccctggttactagcagagccctggctactagcactctcctggttacgagcacagccctggctactagcacagccctggctactagcactgtcctggctactagcactgtcctggctactagcactgtcctggctactagcactgtcctggctactagcactgtcctggctactagcacagccctggctactagcactgtcctggctactagcacagccctggttactagcactgtcctggctactagcactgtcctggttacgagcacagccctggctactagcactgtcctggctactagcacagccctggttactagcagagccctggttactagcagagccctggcttctagcagagccctggttactagcacagccttggttactagcacagtcctggctactagacacctctgctagagactgcccaaagaatatgccatgagttagctctttctccccctcctgccactggtcagctaagccttccccctaaaaatcactttttgatatagagggtgaagaatttccagtatctcctttagttgactgtgagagaaattagtgtaatttctaattgaccatcttcacagagttgtagaatgatcacagagcatttagaagctgtgggttgctaatagctaaatggctttgaaataatgaatgcttcatttgggggaactcggggtaactgtgacaaaccgttgttatgaaggggctttagctagccttggaagggcaggctggaggcttctgcacgtccttggaagtctccatccaccagaaggagctccttctgctctctcagcctggatgtgatagttgccagcaataggcgcaacttggtttttaaattaaaatctaatatttgatatacataattctatcaacaatatattaaaaatatgatttctgctttgcatctgctctttttggtacactgtgtgtcacatgatagatgccacattaatatctttgactattaatagagttggataagtaatacactgactcctttagcagcctcagcctttctttgaactttgcaaacatggccattgtaattaggtgttgttgaattgagaataaaagttactttaaggcagagctaaaagtgttaccgaggagatgctattttcagaaattacttggtaaagactcctctggagttgttagtaccgtatctcattataaagatgcctcttatatgtatttgagaagggaaagaaggagcccagtgttgacgttttatttagaaaatgtgaggccgggcgcggtggctcacgcctgtaatcccagcactttgggaggccaaggcgggtggatcacctgaggttgggagtttgagactagcctggccaacattggtgaaacccagtctctactaaaaatataaaattatccagacgtggtggcgcatacctgtaatcccagctacttgagaggctgaggcgggagaatcgcttgaacccaggaggtggaggttgcagtgagctgagatggtgccattgccctccagcctgggtgacaagagcaaacctccatctcaaaaaaaaaaaaaaaagtgcagtgcaggtgatccccaccgcccccacagcggtgctttctgcgggtgatccccaccgcccccacagcggtgctttctgcgggtgatccccaccgcccccacagcggtgctttctgcgggtgatccccaccgcccccacagcggtgctttctgcgggtgatccccaccgcccccacagcggtgctttctgcagggagcggacggcaggcctggggcgtgctgcccgcttacctcatgaactgcgcgtgcactgactccacattacccacacgtgggaacaatgcagcagatgtcttttttggatccggttgctgtgtatcgcatcgcaagacttttctggatccttcccaaatcctccagaagactctggagagcattggaagatgagagtctttcttgtgtttgagtccctaggctccccggagaaacccctttgggtgcacgctcaccttaggcttgctgtttgggaaaaccatggctctgggctggaattggtcacttttaggcctgggcactgttcacaagcttggccaatcacaagcactcagccttacacgcaggcctgtttctgaaagatagtttcaattacggggtcaatatcttaggtagatgcaaaaccaaaacagtgtataggaaataactcatctgttgaaatagtttttttttttcccttgggttagcaatcctgaagaacgttcattggcagaaccctttggcttgaatgtcaggatgttttttaaaaatgctaggttctgggtgggtgcggtgggtcaggcctgtaaccccagaacttcgggaggccgaggcaggcagctcacttgaggtcaggaattcgagaccagcctggccaacacggtgaaaccctgtctctactaaaatacaaaaattcgctgggtgtggtggcactcgcctgtgatcccagctactcaggaggctgagggaggtgaatcgcttgaacctggaggtggaggttgcagtgagccaagattgcgccactgcacgccagcctaggcgacaaagcaagactccctctcaaaaacaaaaacaaaacaaaacaaaacctgttggttctaatacccctaaagcaaagagctctcctgtgtactcgtccatgcacccagtagtgtggtgggaaagaaggaattcagcatgcttcctcctgggcctggcagacaggtaccaggtgagtggagcactgtcattgcctgtcacttgctgttggaacctctgcagccagagggcatgtcttcttgtctatacatcaacgtactttggggggcttcttaaataggtggggtttctgtcaatgatcacactgaatggggaaatgaagtttctagtaggcatatttgggataaagctctttctacatctacctgtccgactgctccctcggcaaccacagaatgcttccagtgtccagtgtgctccaggaggcattgggccaagcgcccgtgcatctcagggtgcaggctgagataggcacggcagatgcaaacccagcagcgtctggaccacgggagctttgtctctccaccggacaagacacagacttcttggtccctaaggaagtccccttcaaacctgctgagttctcatgtggctcctgtacactggagactcgccccaccaccccatgccatcctatgttctagtgctgacttggaagaaaggtgggttggtatgaaaagtgttagatttcagaagcttggcacaaatggttggcagcgatggagggactgcagtgtttagaggccatggtgggaggacctgttggatggagggactgcagtgtttggaggccgtggcgggaggacctgttgggtggatggagggactgcggtgtgtgtttagaggccgtggcgggaggacctgttgggtggatggagggactgcggtgtgtgtttagaggccgtggcgggaggacctgttgggtggatggagggactgcggtgtgtgtttagaggccgtggcgtgaggacctgttgggtggatggaggggctgcggtgtgtgtttggaggccgtggcgggagggcctgttgggtggatggaggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaggccgtggcgggagggcctgttgggtggatgggggggctgcggtgtgtgtttggaagccttggcgggagggcctgttggatggagggactgcggtgtgtgtttagaggccatggcgggaggacctgttgggtggatggaggggctgcggtgtgtgtttggaggccgtggcgggaggacctgttggatggagggactgtggtgtgtgtttagaggccgtggcgagaggacctgttgggtggatggagggactgcggtgtgtgtttagaggctgtggcgggaggacctgttgggtggatggaggggctgcggtgtgtgtttggaggccgtggcgggaggacctgttgggtggatggaggggctgcggtgtgtgtttagaggccgtggcgggaggacctgttgggtggatggaggggctgcggtgtgtgtttggaggccgtggcgggaggacctgttgggtggatggaggggctgcggtgtgtgtttggaggccgtggcgggagggcctgttgggtggatggaggggctgcggtgtgtgtttggaggccgtggcgggagggcctgttgggtggatggaggggctgcggtgtgtgtttggaggccgtggcgggaggacctgttggatggagggactgcggtgtgtgtttagaggccgtggcaagaggacctgttgggtggatggaggggctgcggtgtgtgtttggaggccgtggcgggagggcctgttgggtggatggaggggctgcggtgtgtgtttggaggccgtggcgggaggacctgttggatggagggactgcggtgtgagtttagaggccgtggcaggaggacctgttgggtggatggaggggctgcggtgtgtgtttggaggctgtggcgggagggcctgttgggtggatggaggggctgcggtgtgtgtttggaggccgtggcgggaggacctgttggatggagggactgcggtgtgtgtttagacgccgtggcgggaggacctgttgggtggatggaggggctgcggggtgtgtttagaggccgtggcgggaggacctgttgggtggatggaggggctgcggtgtgtgtttggaggccgtggcgggaggacctgttgggtggatggaggggctgcggtgtgtgtttggaggctgtggcgggaggacctgttgggtggatggaggggctgcggtgtgtgtttggaggctgtggcgggagagcctgctgctcagttctcaggactggttagaaagtaaatttaacgtaggagcaacttaacaaaaagaaaagcttttcattttgggggctttttttgtttgtctttagagatggctttgctctgtcacccaggctggagtgcagtggtgccaccacagctcactgccaccttgaactcctgagcccaagggatcctcccacctcggcctcctgagtagctgggactgcaggcatgcaccactacaccaggctgattttaaacaactttttgtagagacaggggtcttgccatattgcccaggctggtctcaaactccagagctcaagcaatcctcacacctcagcctcttgagaagccaggactacaggcatgcaccaccacacctggctaattaaaaaaaaattttggagtgatggggtctttccatcttgcccaggctgatcttgaactcctgggttcaagtgatcctcccacctcagcctcccaaagtgctggtattacagatgtgagccaccacacctggttatataaaaagaaaacctaaaactagtaaaccacactgatattttttgctatatttctgctatatacatgtccttttgaaaaggaaaataggaatattgaacttagtttttgcgtaaagggccatttcctcccacttaaagttgtttcctttttaatcctctgccagccattcttacgtggccagtggtagtggtgctgattaaaataacacaagtctgccagcagtcccagacagacatcgcaaatggcgccttccacagttcaggactgtgtgcttcactccacggaggtctgcctcagatgcctccctcccagcccctttccggaggccagggagagtgcgtttccaccaagcgcaggagtcagcacttcctcatagccttcccgtgccctcccagcaccaggcacacatggccgctcccacctatcccatccacctgttgtgacgcgggtctgagtagctgcaggtccacgtcgttcctggacccatcatctggcttagtgggcctgtcacagcagacctggaaactaattttctgtgtacagcaggttgcattgccgatgctattttagcttatggagcccagagcccaggaaatggttttaaacatgattttgccttccctcttccctcttgtttaaaaaaacccactccttggtggttcttggtgattgttgcgtggcatgtaaatatccctaatgtcaccgaactgtacatttgaaacagttaacatggcaaattttatgctacaggtaatttatcatcataaaaaaaacctcattcctctagaaattgcagtttttattgaaaaagttaaattatatttattattaagtatatgagaatttgatttgtactctgggtttaatgttcctgtggtagaatgggttattaataaaactagcagtcattagtaccttccagctgagaaatttgagatgttaaaaacaaagtttgtcagagtcagatgacagtgcgttctgtaccatcaccgtggtgcgaggtggctgtgagtgaatacagctctgtgtgtatttcattccgaaagcactgggcgtgctgtctggagagggctcggcagctttcgtgttggcgtcgtaggtgcttggtggagattcagaaggacccagatgggataatggggcaaaagcagccctaaaatcaggggcagtgcccggcactctggacgcatgtgctggcccagctgcagggcagtccgtgtcatctttggggactctgtgtcctcgtcgtcacagctcttttaacatggagctgaaacctcatggggttggtaaaaagcagatgaaatagtatatgtgaagagccgtgagaaatactaagaactacgcaactaaaagtaaggagcaaggaaggagcaaaaatgcagacacagacacattctctccccgtcaagccggggagcgcatcgcagccctcggtgattaaaagccacacactctggacacatctcacccccacccatattcatcgtcacttacaatattcatttacaatagcgcctcctcttcatggaggcctgccacagtctgagtaaacaaaagtgatcttgtccctgtggtattcacaaaacaagccctaggaattgtgtaagtcacaaacagcgtccaggccctggatctgggacgaccagtctctgtcatgcgatgctccagccctcatgctgaccgcttggtccacgaccccgcattagcaggtggcgctctcagtctgaagcctcattctgtaccttgttgttccacatccccagcctagatgggcagatgaggttggcccctacagcagaatgctttccattacagccgaattataggtatttgtagacacgtgaatgaaggagttctgcaagctgtgtggcccggtatgatcggcatttttggggttttctgttttcattcctttagctatctacatgacatgcccaggcatcacatttcagggtaactgaagagaaggcaatgcagattccatctcacagcctgtggtgtgttcttcttgttttgtctgttccctgtctctttctgtccctttgtttcctgctaccctttcccctctcccctctccccacaacaaaggaccagccttgatgatagtgcaggagggactttgcaagccaagctctcccagggcccatggggcctcccttccagcaggtgggccctgcatgcagcccacagtgtctgaggactctgcatccccggaagggaggcattgcttgtgcgcagctgctgtgcctcccccagctgaaagcattctgtttggtggaactggttctgatattttccagctcttctcaattatttccaggagcaggcagagcagtgtgtgtacataatccctcatgtgttatacttattaaattttactggccaaaatgccaggaattcttgtgaacttcattatttctgaaaacgacagcaaaacctcttgtggattaccgaaatggccacatgcaggcaacgtaggtagccagggaaaggaatcacaatctcagtgctagtataattagtccttggtggtataaggatcctgttttgttgaatgctgtggttttttggtaaaacaggaacccacctggtatccatggcagggtatagcaaactcgtgtatcagacagtcctgtcattttttaaacctttgaatgtaatgcattatttaaaaagaaggaagagttacactttcagttagatttcatttggtaaaaagtgaaattttctgtgcattttagtagtaaacaacaattcacttagtgcctttcttcctaaaatggcactgtgatatcagcttcacatatgatacttttacgtgacaagtctcattgaaataaataccaaccggcattactatccctactttaaagagagattaaattttgaattcaaaaacacctcacctttctccctgattacaaaattaatgcacatttgtttgtagaacatttagagaaatccgatgaagatgggaggagataaaatccccctaatcccccactcggggatgagtgctcgctctgtctgtttttcagtctcttttgatgggtcgctttagtcagcccactcaaactcacattttgtggtttgcctttgtgttggtgatggagttcacatcatataacctgaacgtcttcccatgtcattaaacacaacaaaataaggttaggatagattaagattgaacgtttaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgtgcgcctgtagtcccagctactcgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaagattgaacgtttaaaacaaaccgtaagacaccatgaaagacctggtggacagtgatacaatcctggggtaagtagggtcctgcaaagaggaaaaccgggaagaaaacagagttgacagagacacaaccaggctgtgccatcagaagggccttgggaatgagacggccaggtttccaggcttacagtctgtctctggagacagttcagcagcgacgcctctctccagaggactttccagtgaaaactcacagcctgagttgatttattctttccttctgtgttacagctgcagcttactatttggttgtgaccagcagctaaatcacactctcttttcccgaatgttctgcccttcaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggtgagtggcccctgctgtgcccctgggacccactcaactgggctctcccgcagggaccccaacccatgtgggccccaggcattcacctggtcccaggagcccacgtgacagacatgagtgtccccgccttctttttgtgtcattcgggattccaggtggaggtttgggttctactctttgagagctcaagatccttcttccttctgatctgttcgtgggcagctcactgctttgcgatttccaagaacaccctctccttacctttgttcactgcggaggcgtcttagtaccaggataggtcatactggaaactggactttctttcaggggaagaaaaggctgttatgaaaaaggaagtcatttaattccttgcttgagttgaagcgtaatctttcaatgtatttttagcaatgaaaaaagagccatgatttttctgtctccatcctttttaagttatagccgtcgggaacataactgaagaaatgtgtgtgatattccaagatggtagaagccgcatttcagccccaacatccccagcagaacgcacagtgggatatgtgtgtttcctgcctccaaatccaatattctcccctagaccatcttgccagtctttaatatctcctttcccattttatgttttgctgaaaagcttatatgtcgtggctgttaccggctagtagataaatacctctcccttgaggtgccgtgcgaatggtgcagctgtgcagcagacaccgtgctgtcggccgaggacactcttgaggcttctgtcaagatggcctaacactctagacaagtctcctgccttctcacccacagccctgggcggacacggggagctaacagcacagcaaagtaagggcccccagggacaccctgggaggggccagaggggcagggcagcctgaggggggaggaaaacttggccttcctgctctgcctctgcagccaagtccaaattgatcccagaccccagggctgggggttcatgatgttggggtgactgcagcgcagccctcacattaactgtccctaggcctccccaccaaacttgagggctacaggtttccattcagggagagacctccttttagtgttactcaccccaaaatagttggagatgaagggaagagggctgggtgtggtagctcacacctgtaatcctagcactttaggaggctgaggcaggaggatcccttgagcgcgggagttttgagaccagcctgggcaacatagggagaccttgtctctaaaaagaaaatagaaaaatagcaagtgcagtggctcatgcctgtaaccctaatgctttgggaaggtgaggcaggcagattgcttgaggccaggagttcgagactagcctggccaacatggcgaaaccctgtctatactaaaaatacaaaaaaattagctggatgtggtagcacatgcctatattcccagccacttaggaggctgaggtactagaattgctcgaacctgggaggcagaggttgcagtgagccaagattgtgccagtgtactccagcctgggtgacggagcaagaccctgtctcaaaaaaaaaaaaaaaaaaaagaaacaaaaaaagaggggagaggagctgtctggagggggcagcagagagggatctgcagtgtttctgctgtccagccagtacccccaccttacctggctgatgcagacttagcctgaaagggccactgtcctctgcacccagcggagcagagctcacttggcaaaactagacacctgagtagcacagccactacgcagagagaaagctgaaccagggttattgtaaaacaagtgtaatacatacaatcaaagaaataaaggaagacacctgtaacaagatgtgagaacaatgctacagttttaatgccttcccccaaatgtatgtgctggaaacttaatcccccacgcaacagtgttgggaggtgattgcatcatgagggctctgccctcacatttaggttaatgtcactgtcacaggggtaggttagttatgtgagagcaggttgtgataaaagcaagcccagccccttgtgttatcttgcccttccaccttctgccatgggatggcacagcaagaaggtccttgccagatgccactctttgaccttggacctcccagtctccagaactgtaagaaagaagtttctttacttagatgaagagaagctgcttgaaaagtccaagaatacagttaagtaggaggaataagttatagtattccatagtagagtagggagattacggttaacagaaataatttattggatatttcaaaatagcttggagagaagaattgtaatggccccaacacaaaagatagaaggtggagtgagatggtggaatagaagcctccaccagtcttcctgcagcaaggataccaatgtaacaactatcagcacacacagaaagcaccttcatacgaaccaaaaattaggtgagcgctcatagtacccagtttagcttcatgttgctgaaagaggcactgagaggtagaaaaaacagtcttgaaaagataaatgtttgaggtgatgtatgagttggatagatcccagttaccctgatttgatcattacgcattgtatgcacggatcaaaatatcacatggagccccaaaatacatacaactatcatatatcaatttaaagaatacaaaaaaaatttgttataaattactcagtctgtcgtagtctattatagcaacacaaaacagacagacagacaagaaaaagtactataaaagaagaacaaagcagaaataggggtaggtgcactgtaatgtttgaaataaagaacacagtagacaggacccatagcaggagagacactgctggagccaaatgaatggcctggaagactacagtgggggctcacaggaggccatgggaaagggtcgagatgggaaacagaaaagccaggagatgcagagaagggaaatagaggccccagtatgcagactgggggcatcccgtgttgagagaacaagaatatggcagagctgaaaatacctgaagatctcggaaatgcactccccaaaattgggaaagctggaagccctccaactgagagggcttgtgccaaccagaaattaatgggagacctccgacctcagcacatccagtgaggcggaagaccctcttgagggcaccttccctgacgccacgttgtttctgaactgctctccatccttgtttgtttgctctgtaatgtcgaagtcctttctgaacgcagatctcttttcacgtaccagtttatgaggcacacgttacagtgtgcctacctctatttctgcttgtttctcctttcgcattactttctcttgtttgtcttaatctgttttgggttactataacagaatacaacagactgggtaatttaaaatgacaattttttgtattctgtaaattgatatatcatagttgtccatatttggggggtccatgcaatattttgatacctgtatacgatgcattaatgatcaaattggggtaactgggatatccatcacctgaaacatttatcttttctttttaagactgctgaagagacggtcttttggggcctctgtttctcttctctgcatctcctggcttttctgtttcccacctctgtcctttcccacggcctcctatgcgcccctcattgtagtcttccaggatattgtagggcttcagcagcctctcacctttatgagtgttctttttaactctctgtactgtatgtctgatccctgtccaaagaggcttatgagtgcccatttcacgttaccccaggaagagattggtccacctgactcaggagttcatccattcattgcccaaaaactaatttattcagtcccgactgtgtatgtaataagacccatgctaatcactataggagatcctaagaagcatattgccctcaacaaatgtctcctctggttgaggagataagatgtggcttgaaaattcatgatttcaatggatgcttcatgcaagatgaaaatctgaacccttcaaggcaatgtgtgatcaaagaccaagtgaccttatggcaccaagggctgttgtgttcccagaggacagagaaccatggctaagggccacagggtttgagaaagctgcttggaggaggtggaacctgagaggaaggtttcgtcaggagtgcggttgagctcagagagtggactgaagtccaagtccattgtggggtgctttgaatgctgcccagaggaccttgacttctcctgggactctggcacaagagagcccctgaagctgtttgggtagaaaaatgacttcatcagaaccgtgttttagaaagaggatccaagtgatgatagggagaccttggtgaccattaggccattatcatatcagtgcggtcttgagctggtaaaagattagggcagaaagatagaaaatcacccaggggcctgtaggctggagcttctgtagacgcacagtggacactgccgagaaacaggcctcatttctcccatgttcccgtccccgctcccggtttcctgcatgactgctttggtgccccctgactccagaatcaacaccacaccagctctgcctttagactctgcccagaggctctgggctggatactgtatttggtgcgaccctctggggcatttttgcaagttttcaggcagatgggtgggggagcagtgaaggaaggaggaaaaaagacaaagcacaaggggaaccggaaatgacatcgctaccttcctgtgccttccctgccgccccactccagctacctgtcactaaacccagtgcacttcatctagttgacgggtttctctcaggcattttgtttttctgccatgagtgggaaggacttggcttccctccgcgcacagctgtgcactcccaaagacgcctgggccagatgtggcagtgcgtcctgtagtcccagctgcttggaaggccgaggcaggaggatcacttgagcccagaagtttgagaccagccctgggaacacagggaaaccccatctgtaaaaaaaagtaaaataaagaagtatgctttcactctgagggctgctggcctcgttatttctaaaatgggtgcctgccctctgagtagggaatgtgctttctctctaccaaggcatgatgtgtcatcccagtagcccctgaaatccttgtaggagttaggacatagtcagatttttaaaagtaagcatttagtaggaagtgcagtgaaaaacaaactgatacagttaccataagagggactttgaaatcaatatgccacagtggcagacagtggtcatcagataaccactgcctggaacaattgagcggtgtctcaggtggcggctcttttacaataaactgctttctcccatattgaagtgctgaaattaggttgaacatgacattttgctaggtgtctatggcctgtgagtggtaatggactatattcattaaagaattatcaagtgaaatgtgtagttttgtgtgagctaagttaaaaaccaccagggtttttttttttaatggaagagtgagatagtttgtcagacagtaattacgtatgtttttagggttttagttttattttttcattttgaaaagtcaatttttctaattaaaaatgaaagatacattcttttcagaaaattactaaaaagttaaaagtagaaaaaaatcatccaagattttaccatctaaggacaactagtgttcactttttgatgtattgcctgttggtcttttttctgtgcatgtacattttgcactgatgtaagtggacagaatttacgatttcatatccttaacccttcgcattatactagagttccctgccctagatcattagagactcttagtaagtatcattttatatttcactatgttgaagttccatgttttatttagccggagcgtagggctttgggatttaggcgccaggagtatgcgggtgggaaggttcagcctggcactctgatgggagtcggcagacctggttctgtgaaggggcagacgcacttgggttaggcttttcgggccacacagtcccaagtctgctgttgcagcacgaaagagccacaggcaatatataaacaaatgagcatggctgtgttccagtcgagctttcttttttcttttttcttttttttttttttgagaccgagtctcactgttgcccaggctggagtgcagtggcgtgatctcggctcactgcaacctccacctcctcggttcaagcgattctcctgcctcagcctcccgagtagctgggattacaggtgcccaccaccacgcctggctaatttttgtatttttagtagagatgagattttaccatgttggccaggctggcatcaaactcctgacctcaggtgatccgcccgcctcagccttccaaagtgctgagattacaggcacgagccaccgcacccagcctcagtcaagctttctttaaggaaacaggcagttggccagatttggcccaggagctatagcttggcacttcctgctccagaaaagggaactaggattgggctgcagatgacggctgtgcgtgtctgccggtctgcaggtgacctggagaagggcgatgctcgggaaggtggattccctccctccctccctttactatgtaaataagagaaacggtttctaagcacgctgccctcattatgctggcacagctgctacagaatgcggtgtgctgggtaaacaacatacagctttgcttcatttggacaaaatgtgtacatgtgtacttggtggcaagcgtatttatgaatcttatttgatgatgaacttgttggaagacattgttctctaattttttttcatttttgcctgtctttttcatttttggaaactgatttcaataattccaaaatgagcaatgacattactttccacataaatgattatcttactcaccatatacatcaatacactgtaagaatccaaaatatattttttcccttggctgttttctacttctttgattgagtggcataatatcattttagatttattacgcgtctatttgtatactactgaaaattataacccagtgggacttcatttgctgtgggacttgctataaaacagattgatgtctattgcactgtgctgcatgcactagtattgtctattaatgaaaatgataaacattattttggattgaatagaggtcaaaaaacttacttcctttctttcaattaagttgaaggatttccaggactataaatgttaatgatagagcattaacgtgtatttgtcagcgtggaaagtttcgctcctgcattgcccgcaggagacggaagatgcatgggtttcctggcgcgcaggttgggtggaggctcagcgtggctctgtctggccaggctaagtggtttgcagtgcctgtctcatttcagacatttgctgtgacatttgcttcgtattttttcctgatgactcaaccaagaatcattcagaattacctttagaaacataaattcttgtggttttgatgatagagttaaccatgtgttctccaaggagtcttctaaaatacatctgctttgccagagaacacactttcttctgcccgttcagtgctctcgggtcttttgccgcttcctttcaacaacagtccgatgactttgtcttcctgcatatgtgcgaagggagaggagctcactggtcctcccagagggtgaagtaaccgggacacattattgaataaaatgctcttttgtagtatcccactctgtatcttagaccttagtcgtaggcaagtttaatttggaatttgcgtctggagaaacggctttatgacgtttccaagtagagcctcagtatcatggatctcacacagtccccgcggcagcttccaggccgtttccagaggaaaatattttttctccccaaacaagacagtgttctctcactgttccagtctcttgacatatactcaattaagatgaatatcataatgtattgtaatagagctcccgttttaaaagatgacgtgtaaaaaccacctgatggatgcggtaagaaagggaattgaagcagatggaggggcacgggctgctgactccccggctgaaccccgtcctcgggtgctgcaggaaagagtgagattgatgatcctggagggagcccactcagcagcacagccggagactttgctggtcccttgagatggctgagtccccactgggggctggggtgaggggtgaggccggaggagacagtggagctggcgagggccccagggtgcaggcaaggctgagggcactcggctctcctcccactgcccttgataggcatggcctgctgtgctgtgtctggggctcagaaagatggaaaataagagggtggaaagaaagagtttgtcctaccgcccttgtgaaaagagaagtaatccaataataaataaaagtgataaaagacaattggaaatatgaagaagaaacaggaagaaagaccagttggaagcattaagtataaaaaatataattggtgaaataattgaagagatggattgaaaagcaacattatggatagagccaagaataaaccaggaagctgagaagcttgtttgaggagttcccaccaaagggatggagctagaaggaaggggagaaacatgagaggcagagacaaagtttaaatatctaggaaataacattttcttctctctaaaaaaaaacgtagaaaaggagaaaagacaggcttagtaaatagaaagtgtgagatacgatggctaaaatgttttgaaataaagttgtaactgtaaacgaattgaattcacctctcaaagggccatgattcttgtgttggttaaaatcatgatacagcagtctcttgtccatgagacacagatttaaagcaaaacgtttaagcctgggcaaaacagcacgaccctgtctctactaaaaatttaaaaattagctggacatggtggcttatgcctgtggtctcagttcctcgggaggctgaggcaggaggatcagttgagcccaggagttcaaggctgcagtgagctgtgattgtgccactgcactccagcctgggtgacagggtaagacccagtctctaaaaaaaaataataataataaaaaataagaacatgtatttcaaaggttggaaatcagaagatgaaaaagagaaatacgagctaaaagaaagctggggtggccagtcccaatatgacttaaagcagaagctgagataaattattgagaggggcaaagaaaaatgttgtattgtggtaaaacgaacaggaaagcaggaaggtatatactgatgatgactgtgtgcacctgacaacgtggcctcgaacgagataagatgggagctgaagtgtggatggaagcagatgaatgagaagtgtgcttagatacagagacaccaagtacagacaaaggaagcaacgtaaatacgacttttgtcaccgaattaattagccagacctcacagaggcacacaggaccatacatccaacagggaatgtggacatatgtggaccattcacaaaaataaatcatgcgcccgactacaaagaaagctttactaatccggaagaatcagcatcgtgtgaactccgtggcagaccacacgcaatgaagctagaactcagtaacgaaaggacagctttaacaaaagtctgaaaactaaaatcttaaaatccttggattaaagaggaaatattttatattttttatttttttttacatgtacacacttacacatttatttgacttcattgtagaactttgacattaatcccaataactaatctctttatacatattgtttcatcctgacatcaacctgaacagggaaaattgacttatataagcacatagctactatagatgtctttttagaaactgattattgatatatagcagagaaacctaaaatctctttaactaacttgaagtcctgaccgtatgacttcttttgttattttattttattttattttattttattttattttattttattttattttattttattattatacttttaagttttagggtacatgtgcacaatgtgcaggttacatatgtatacatgtgacatgctggtgtgctgcacccattaactcgtcatttagcattaggtatatctcctaatgctatccctcccccctccccccaccccacaacaggcccagagtgtgatgttccccttcctgtgtccatgtgttctcattgttcagttcccacctatgagtgagaacatgcagtgtttggttttttgtccttgcaatagtttactgagaatgatgatttccaatttcatccatgtccctacaaaggacatgaactcatcattttttatggccgcatagtattccatggtgtatatgtgccacattttcttaatccagtctatcattgttggacatttgggttggttccaagtctttgctattgtgaatagtgccacagtaaacatacgtgtgcatgtgtctttatagcagcatgatttatagtcctttgagtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaacgattgccattctaactggtgtgagatggtatctcattgtggttttgatttgcatttctaaagaggaaatactttaaaactgataaaatactcacagccaaatgttagtaatagcacatttgctgtttgtggggtgtatgtagccaaagcaggcgaggatttaatacatttagtcagaaaacaaagattaaaaaaacaagaaaaattaaatgtttgccttaaagagccaggggaaaaatgcaataaacagatgaaaaacaaaatgaagagagcgaatctgaaagatacaggcagccctacgctgtccgtcgcatctctgcatccatagggtctctgcttcatttcctgggagtcctgccagtgtgggagggggcgtccagggcctctgaacactcttctcacagattttcatctgggcacttgctctcagttcttcttttcagagagccagttgtctcagttcttgatacttgctgacagcaggctttgggaggtgagtgcttcattttgactttgcaccgtccaggtcaaaggcttcacttctctcacctctgctgagccacttacgcttgtccaactgtttcttaacgtttggttgacattttacagttacagggataacagtagctagcatttgtcgagcgtcactggagccattccactaatgcactcatctaacaccacacgcctgtaaggtttggactggcgttagtgctgctttcaggatgaggaagttcaggttgcttggagagtagctggtggagtcaggattcaaagctgggtgcccaggctcccgaactgacagcctcaactctgttgttccgcctctctctctcctgcccagcgtctctcatttgccatgatttccttcctggggctctccgtccttgtcctgttctttttctctcgttatggaggaagttgagatcactatcatctatagtctgtcacgtctaaatagaggttaccacgacttacttaacgtggtaaaggctacatcagagctcttcagcaaaccagcctagtggggagactggagacgtcttcccttcgaagctgggaacaaggcaaagattctctctcgcactaaaacagtattagaattcctgacccccagtaagataactccataaccagcagaaggaatgtgaacatttgtaattatctgtttacagtaagggccatctaacatagttcactgattctagcatgtactttttaaattttttttaagacgtgatcttgctttgtcacccaggctggagtgcagtggtgtgaacacggcccaccgtagtctcaacttctcgggctcaagcaatccccccacctcagccccccaggtaactgggactacaggtgtatgccaccattctgactaatttttgtatcttttgtagagactgtgtcaccatgttgcccaggctggtctcgaactcctaagctcaagagatcctcccacctcagccttacaaagtgctggaattacaagcatgaggcaccatgtctggtccttttttaaaaaatagagacagggtctctcccttttacttagatgggagtgcagtgacacagtcatagctcactgcatccttgaactcctgggctcaagtgatcctcctgctttagcctcccaaagtgctggaattccaggcatgagccaccacgcctgatcccagcatgtgcgttttcacacttaacatatctggggtccagaagcatcttacaataagtaacatacctgtttagttggcagttcttttcctttgttaatagtgtatagaaatgcttgcaaaggtccacctagaggtgtgcactgtaccctttcttactgctgtttgtaagctcactgtttgtcactagggaaagaaacaggcaccattacttaactaggtgttcatgtaccggcaataattgatctcaaaatttaatgctatttgtagtttttaattaaaaaactctcaaatgtatggtctaagtttttctttaagtccagaaaaaaaagaatacattaaaccctaagtaagtagaagaaaagaaataataaagagaagagcaaaaataaacagaagttgaccccaaaatttgtaaaaattcatgaaactagttgatagtttttgaaaggttcattaaaattgtcaaaactttttctagagtgctcaagaaaaatagaaggaagatacaaatgactttcatcagaaatgaaagagggcacatccttactgatcctacagatgttaaaagaataaggggccaggtgcgggggctcatgcctataatcccagcactttgggaggccgaggcaggtggatcgcttgagcccaggagttcaagaccagcctgggcaacatagcaaaaccccatctctacaaaatataaaaattactcgtgcgtggtggcatacgcttgtagtcccagctacttgggaggctgaggtgggaggatcactgggaggcattgaggctgtagtgagcagtgcagtgatcacgtcactgtggtccagcatagaccacagagtgagaccctgtctccaaaaatgaaaattataagtaaataaaaggagaataagggaatcattttaatcatgaaggaccatatgccagtaaattcttcatcttagatgcaatggataaattctgtgaaagacacaagttatcaaatctgacagaagaataaaaagaaaatttggataggatatatctgttaagtaaattaaatttctggttaacaaccattcaaagacaaccccgcacccagatatctttactagtgaattttaccaaacctttaagatgaacagaatagacagacaacctttgtgaaatgtttaaatatctgctgaccatattaagttgctgtcccaaggctcggtgtaattagtaatggtaaaagctaagaaaatctttacaaggttactgcctaactgttgactaatttgaccaaattttatgcacctggggccttttacaaatcagcttacttccctaagaaaaagtgttacttgaattttttttttatgattttattttattttattatttttgagacagagtcttgctgtgtcgccaggctggagtgcagtggtgcaatctcagctcactgcaacctctgactccctgtttcaagtgattctcctgcctcagccttctgagtagctgggattacaggcacgtaacaccatgcctggctaatttttgtatttttagtagagatggggtttcaccatgttagccaggatggtctcgatttccagacctcgtgatccgcccgcctcggcctcccaaagtgctgggattacaggcgtgagccaccgcgcctgaccacgtgaatttttttttaagagcagcttgcctttatatttttggttcacgttgggacttaccttctagtcatttactgttggctcacatttcctcttctcccatgtctgtctaacgggagaaccatggagtgcgtgatctcacttggggtctcagtaggccgcttagtgagtcccaaagacttttgtgagagtttgaatgcatccgtgtgtaatgtatctggaggactcaagggtagcaagtatacacagagtatccttttaacataaaaggagcattcagaaaagaattaagactgtgcagttcagcccacagttgggctctcatagctactgagttattcatgtaatcctcggaaatcagcttgggtgaaatactgcacgggaaagagtgctcagccccggcctcactcctgcctgtcccaggcctcctcactgtccgtgtctcatgggaagaaagtcatttgttgtctcctgcttgatgtcatcatcactatgttccagattagcttcaggacttgtttgaaatcatacctactaatcgactgacttatatccccatcacacggtgacatattaactgcttatttgcctctttgtatcttcttcttaaacttctgggcattttagtggcagtttggcttcttgtttgatttatgtgcctaagcgtgctcatgcctccatatttaatcagtgacgttaggtcacattgcatgcaaaaactgtcagtgcattcagctccgtatttaatagcaggcattcatgacccttttttaaataaaaaagcgatcatttgatttgtgctaaactggacagtatattgcggaagccattttcatcctcattttacttgtgctgagatcgaatcgataatgcctcttgatggcatcattgttggaacgccagaaccgtgctgtcacatagacctgtatggagggtggcatgtgtcccacgccagagccatgccatcatgtaggcctgtgtggagggtggcatggtgtcccacgccagaaccaagctggcaagtagacccataaggatggtggcatggtgttgccagccttgttgtaaaatggtgtgaattaatccaggagacgttagcctcttctttggtttctcgttatttgtactgctaagtaaatgttgtatatgtatgttcagtacatagaacaatttaaactggattcagaagccatttcagtgcactctgagactgggcattaaaccttgctttaagtactgtcaccacagtcactgagaacagcccgagtgctgcttacttgcaggttgaaaggactctgtgcaatgagaacttctgagttcccatcctgtcccaggtagccagtaaacacctaagtcatgaaggttatgagacacagtccctgtgtgcccggaaaagagggtctccagggagaggtgctccctctcatcagtgctcttcttggagacagaggagggagtagggatactccttctgcttgccttggaggcagaggcggcatcactgctgttggggtgtcctcgtatcacccgctatgatgagtgaaatttcaccagcaagaggaggtggagaaaggcattgtgaggcactcaccctgacctgctcagaggcctgaacgcatctcgaccagcagcccagtgtggcatctgagtgaaggatggtggccaggacacgagagggagggcggggtccgtgaccatgaagctcgagctggaatttcttctgttggcagtgccttctttgtggtaggtgctgtgcagctgcagggctggcctggcctgcagagccagtcacacgggggtctccacccttgtctcagcccactagtgctgctgcacaggcccctgaaacagggtaatttataaagaacagagttatttctcccggttctggaggctggaagtcccaggtcaaggcatcggtgggtttggcgtctggtgagggctgttctctgcattcgaggtggcgtcttttcccgtgtcctcctgggaggactgctgcatcctcacatagcagaaggcagaaggcagcagaggctatgttcctccagcacccccgccttaaataaggttgctaaaatcccactcaggatggcggagccttgggatgtaaccgtcatctaaagcccacctcttagcactgtcacttcgggtcctcagatccaacaggaattttaggagggacgtgccttctcagcgtagcagccctctgggaaatgaaagcctgtttgagaagacatgttcgtatctcagcagcagcgtggtccgggctctcctgaggaaggtgcccagggcatttggggacacagaggagcaaatttcatccagcaggggcagctcactgtgtgggtgaggcttagaactgggcatggcggtggctgtcggatggacatgcaggttcaggatccaggtatgtctgtcacctaccatttctaatggaggacaacgatatcatcagttgtgaacacatcttctctgttactgttcaagaagccatgctgtttgcattctctaagaggaaaatcgcactgctggtagcaccttcaacctgcaattcctacttacccgcctcaaacgcttcctgtcttcacttttgctgtccgcaagatccccaccttccaatccacaaatgtttgtactcaaatttccccagcagaaccagcaataaagcacagaaagcagctgacctaagcccacccacctctttccttaaatcgggcatcttccccttagacagagtgtctggtttgcgctgctgtcaccactcagcttctcccagcatacagcgtgtgctgcctctcctggcccggggcagtcccctgccttcctgccattccagcagctctcccggaaccatcgaggtgatcgctgccttctgagccgtcagcctcactggcctgtccctaatccttgcccctgaagagtccgctgcagagctgaagcaagggacacccccttcagcacctccttccctgccctggggtctgcggctgcctctctgaagctcccactctctggccagcctctcttcctgcacttggacgtatgttctcccacggctgtgttcttggccctcctcttgacgtacttctgcctgtgagaaactgcagctcatccagcgatcactatcctgacccctctgagataatccctccttcctcacgctctccctctgccagcgctttcctcgtcatatacacctgcataaacctctcatgcctgaaacaaaaggtccaccccagcaagagggcactcccgccgcccgctggccctcctgggcctcattgcctagttctttctctccaggtgcagttaagcttcaggacggaagggggtacctcccaagcctttctgcccttcctgtccagccctcaatattgtaatcaggtctcctcaacctagaacgccccctctccttcccagccccaggtgtttaccctggttgtttgtgtttcttgtttttctgtgtaatggaaggaaggtatcacctgagaggccttaggaatgacacaggaaaccctgctgcctccattcagacttgggtggggtgggggtgggtggaggccagctggcatctcccaggatttctgaaccctcgtgtccctcagccagccaccgccatgcccagctccaggcctcgcccccgatatgggggaagctgttgctgctggatctgacgtgcccgtcttctcgctcgggcaccccagctggtgcgtagcgaggcagtcacagctcactgcagcctcgacctcctaggctcaagtgatcctcccacctcagcctccctggtaactgggtctataggtgcacaccaccatgcctggctaatttttcacattttttgtagaaatggggtcttgttatattggccaggctggtctttaacttctggcctcaagcagtcctccaactgcagcctcccaaagtgctgggattacaggcctgacactaatttctgcacatagaggtgaggaggcacctcgggtatcagggtagtgaatgagtgcctggaccacacaggccagagtcgaaatctgttcacctgccttaatctgccactgtttggctgcttttaaaaaataaatgtacatctttgtcttggattgtcttccttaatatcacatccaaaaactcaatactagcaatttttcagaagacctcgatgttttgggcagcccttagacctccctgtcacttgacccaaatggtgctgggttgaccccagtccagcagggaccaccagtgctgtccccaacatgactggttccccctgtctctccccccacatgcctggacccccttcctctccctccacatgcctggacccccttcctctccctccacatgccctgttccccttcccctcccccccacatgcctggtcccccacccctaccctccccgcccttgtctggtcttcagtgcctccctgatgaggggcagctgcccccattctcctgcggcagcttcaccagccacacggctcatccaatggcttggaccttgtttcattcactaaagcaccagctctagcactgtgaggtcattattgagtttgtaagcaaaaatcttcttaaggaacagactaatgtgtatttaattttcattatgtaccaggtacatattaagactttttgtttcttttaatctcagtaattcctgttttatagttccattatcctcatcgtgtaagtgaaaggtaagtggtggcagccggacatcaaggtgtgaactcgcctggggctgtacaggggcagagccagggctacgatttgaaccggggttttctgacctgagcgctcttctcttcattaccttctgcctcctccttctcaccacttaagtggcttcatgcatgcagggcttttaaaatgagattttctcaaagagccgtgtgtctgcaggtggcatgcgctggcactgggctattgggaggcacagagttgttcctgggtctctcccactggagaaagcagtgtgtttggctgagccagtgacacagggctgcccgggagcggcaccaccactcttgggacaggtgggcaggcgctgttgatgtccctggatgttgtcccttcacctgcagtttgtcaccaaagccccgagggactgtggtagagacacagctagtggggacttctctgttcgcacagagactctgcagttgcagctacatcacactctggtaaatagcgcctctggcagtgggttttaatatccacgttggttgttgaagcagtatattctaggggtgcctgggaagacagtcgtttaaaatgtctctgctttttataggtcagtttttcttcttctttctcactcccttgccaattgttggacttaaagtttgttggaaaggcccttcctttattttgatttgtgcctgtgctttgctccaaggcaggccactgggggcattttttacaccgaggacttggttggaaccgttaaccagtggctggctggtctgtttgtttacaaggcagccccgcagccttgttctgagctggctggctcctagatgttatttggatttgcttcctctggcaccaggccctcctccaggcaggcgcttgggcaggctggtgggactgatgggtagccttgctggggacgtgtagtcactgtggcgctgccagcaaactgttctttctggaagaggaacgcttggtgcctgggtgtgttcagtgtgttctgttgtgcatcagagctccctcagacgtcgaccgcttctgattccctccagacagctcccggtggacacgcagggctatgcggcctgccctgggggctatggtgctgaatcctgacaaaggccctcttctcgggctgtcagaaaggacgaggctgagtcaggctttaatgtaaaccatcactccctgtttttctatttcttcgttgaaagaagcactgatcattgtgttcactagaaacacctcaagtttttaaaaggctcctctcctgttggtgtgactcgagggcgctgtgacatcctgagaaagcggggactctgggagtctggatgtcaagctggtcccgtctccacccgccttgagttctcggttctcgacagcgcccgtgtgatgatgatgctcacgctccggtgtgacacagacggcgcgggagctgcacgggagagtgctttggaagtggaagccgcaatgtcatgtaagctgttgagtatgaattgtatcatatttcacaatccacagagtattctcccttatggtgtcacatttgctcttactaataacccaggacttgtcaaagcagacgtagtgcataaaacatcactgtgttactgatgaggtaccagatgctccgcgtgcggccgtctggggtggacagcttcatttatggcagagccaaacaggagcccggatcttctgatcccaaatcccgtattattttcactattccatgctgcctgccttcaccaacgtgagctgaagttattacatgttatcactttacttgatgccgtgccgtactttacacgagaaccagcttcccgttggggactttacagagctttcggcagggacagtaatgggggcggcccctgggaagctgtgcaaagtagcatttgcggcgccacatcccgcagtgtttcctgaggactcgctgtgtgcaggggaccgtaagatgccacagagaaatcaaggaggctgcggacacagtgtctgtcctcaagtcattcatcattccctttctctgcccctctgccgtggaaggttttcaagtaattaagctgcttgcttatatgcagctttcctccacgggccccgcctgtgcgtagtcgtgctctggcagagtctctgcaccttcctccctcgggctcctgggcctgtgtctgtccgtcctccactgtcttgctgtctgcatcttcatggtgtaagtctggcccctcagccgccccacaagcctggcccggggccaggcttccagccgctgcttcaacccaaaggtggaacacctgtttcctgcagtggagaagatgggaaagccttttctgcagggcttttactcccacttccttcttgttttcagccattttctctgtgctgtttttctcctttcttcctgagactttcccctttgacttgttcttagtcttctttctttctcttttgaacaggtagcggtcttgttatgttgcccaggatagtctcaaactcctggcctcaagcgatcctctcgcctcagctttccaaagtactgagactgcaggtgtcagccccatacccagccagtcttctcttttctttactttgagtttaggcttcttgagttgttttcttcttctcagatgcttcagggggtagctgagaatgttgaaaatactaaagtgcagcagaagcaaggaggcagagccagccctggtttcccactgatgatcaaatttctttttagctcagaaatactggcttatgcctaacccatcaaaggtgcagcattgttgggcacaggatgaaaaacagacagcccccacgtttggctgtcaaaccacatgacccagaaatagccatcattgtaagaaccccagagggagcctttgctatcttttaatttattgcacaaataatattataacagtaaacaatgaaaaggaagaaatgaaagaaaaattacccagaatccactgtttttgctattccatattcttcatacatttgtccatatatgcacataattttacttacttggaattaaatatattttgtattgtttttaatttgaagatcactgattttatattgctattgatattttcaaatttagtattccatcacatttatagacagtattacttaatcatttccctctcataaaattatagtgcttgcaaggagttttttcctgttcatctttgcggtacatagaaccttccttagctgtccatggtagcatgcagctgtagtctcagctacgtggaaagctgagatgggagggtcacttgagcccaacagtttaaagttatgatgagctatgattgtgccactgtactctagcctgggcaacatagcatagagtaagatcctgtctcttaaaagaaaaaaataataatattttcttattttggactatttcttagaatatgtttctgggaataagatcagtaggtcaaagtatatagctcttgatatcttttgccaaacttcctttttttttttttttttttgagatggagtctcactctgtcttcccaggctggagtgcagtggcgtgatctcggctcactgcaagttctgcctcctggattcaagcgattctcctgcctcagactcccaagtagctgggactataggtgtgcaccacaatgcccaatactaatttttgtatttttagtagagatggggtttcaccatgctggccgggctggtcttgaactcctgaccttgtgatccgtccgcctcggcctcccaaagtgctgggattacaggtgtgagtcactgtgcccggcgctgccaaacttctttactaaaaggttgctctaattacacggccccaaatcacacatatatgaaagtgtcattttcaacacaacattattttcagagagaaaatgttccttactttgcatattgcaggggaaagactgtattctgcaggtcctgtacgtgactgcaagaaaggaccagtattacaaggccagagacagagaaggccccacagtgacatctggaccgaccagtattacaaggccggagacagagaaggccccacagtgtgacatctggaccaaatctttttggtgaacccaagtgctgagttattgatcaggaagtgaagggggaggccgggcgtggtggctcacgcctgtaatcccagcattttgggaggacgaggtgggcagattacctgaggtcgggagttcaagaccatcctgaccaacatggagaaaccctgtctactaaaaatacaaaaattagctggacgtggtggtgcacacctgtaatcccatctactggggaggctgaggcaggagaatcgcttgaaccagggagtcggaggttgcagtgaaccaagatggcatcattgcactcccagtcttggcaacagagcaagaccctctcaaaaaaaaaaaaagaaaaaagaaagtgaagggggagcggaggccagtgtgggaggaagagacaggaaaggtcatctggatagtaaagatcacctggtttcatgttatttcgaaatttacggataattttagatatgtggttgaaaactattaaaaacttgaatattcaagcaggactagagaaagtgtctctggtatgtcttcattccagccgtcctgctgtgtgtgaagtggtatctcactgttccgctttgcatctccctaacgactaatgacatcaggcatctttttatgggcttattggcctttgttgtttttttttttgagatggagtcctttgaggtgggaaagttttattttattttggtaaagtccatcttatctattttgttgttgctgtcacctgtacttttagtgtcatgtttaagaagccgttgcttaatccaaggttatgaagtttgacgcctgcgccgactccagcacttttatagctttagctgttacgtctaggcctttggtccgttttgagttaatttttgtaaatggtgtgatgaagtcttaaataagcatagcttggacttttggatctatttttaactttgagaatgttttctgcaggaatggcagaaatagatgtattgctggagtgactttggaactgtataaagaaaaggtgaacgccagaggctgaagagggaaggagctctttccctagcaggtttctgtgtagcgagcatccgtggctggggttaaagtgttatttcattatgcagtttatcaaatgggaaaagacaaaacctaagggcatttgtatctactccataccataaaagtttgccattttactttgatcatataacaactctgaaaaatactgtttttcatggattaatcaaattaccaacattactttaaaatcacaccgagtcactctttctgtgccgcaaggtgctaggccagtgacatctctgatcttgggagccgctgttaggagcctgatgttaatgacagataaaaattgatgtcagatagaaaattaacctccttcagggtatgtgaaactgcttcccctaatcctatgttcttccttagcaaaccgaatgcaacccaggagctctgaagaaggaaaatgatcagctgtttatctgcttggcaccctttggaacagtcattttcccatctcatttgaaagcagcagttagaaaaatcacaaagaaatagtctttctaaagttttccttccattttaattcttttgtgtttttcttcatcacattttccatacaccccacacgattaaagaatggtcattctgcgtttcaaggggcccaggcgggaggatcacttgagactaggagtttgagaccagcctgggcaacatagcaacacccagtctgtaccaaactttcttcaaaaaattagcctggtatggtggtgcgcctatggtcccagcttctcgggagaaggaggcaggaggatgactagagcccgggagttcaccactaccgtgagctgagatcatgccactgcactccagcccacacagcagagtggggcaagacctggtctcttaaaagaataaaatattgactgaggatcaggacggtaaaatcacgagacctcagagaaggaacaactgtcgtggcacctcatgtgcggtgtctggccgcggcgcctgcgaatgggttttgctcttggttgtcttggaaccaaacatctgtgtgctggcatggactggacatcgccaggtgtttggaccatatctttgtggtttagcacaaaaccaagacatacagtttgtacctgtcatagtcactggagaagccgtgctgttaattgatacagaaacacagccgtgggctgagatgcaccttctgagcccatggctgtcctcagcctcatcacagaccccaagctgaatggtcctgccggactaggcatgagggctggagctcatgtgtgcgcccgtaagctggctttccattcagtggtttcaacttctgcctgtagaaacaccaaaattgtccatgaggtaaatgaaaatacatcccaggacactctcactgtcctcccattgtctggtgtcttgttgagggctctggccaggtcaacaggcaactgttttgtcctgtgaaagtgtggcgcctccgtggctttctgggagaaccgaagagagagacttgcagtcggcgaggaactccttggcgcaagcagcgtgcggatctcctcatgcttctgccgtgcctacgtgcactgacgtcgtcacaggtgggggataagattccgtcgcggtcggagttttcctgtgtgaacattgagatgtgcaattccgtgaccgcaggcactgcccctccgacacagtggggttcatctgcttgcggaagcctcttaagggcggttgggagagaccctcagtggcgcatgtctggaggctgctgacctagcgtcgcaaccatagaccaggaacacaagcagataaaagcagcaagtgggacagattgaaccagctcttggcatagtttcccaccccccagctagttcaggagtctgtggacaaactgtgtttcaagcatgttgaacaacgcagtgtgcatttccaagttcattggaaaatctatgtgagttcacttgtttgccaccagaatgccaggagtgagctccgttctcggggtgctcttccttagcccccagtttttgcggtggcttaaggctctgcaggagtcgggggtacccaggctccactccttggcccgactccatgctgttgcggctctcatctgctgtgggaaactcgctcctcgtggacattttccacgcctctggctggatttctgctcagtagccttcagccagcggtgttctcatcgtgtccatctgcttctattaagttaatgggcacagacacacggcccataaagcagctggatcaaaagtctggttcttatcagacgacttaattgataaatgtcgcaatcacaagaagctgaaatgctgttgtgcaatgacttccagaatggtgttctgggcacgtcagcttccctaagtacaactggagccgtcggtggagaagagcggaaagggagagttcagttggtaggagggaggggtccagcgagagacagggatgtacacgaagtctgtttaactttacatattgggtgcagaaaccaccacggtttaaatgcttaggaagacaactggatagacggtggtttgtttctagccctgattctgaactcatctgtcctgaaaaacagttgctgacaccctctgaccctcagaggcggtccgggctagaaggggattagtggaggacatctcggcagggctgctgtaggcggatgttgtccagtcagagcggaaccgtgacctgtgatacgtatacttttcatttttgccgtttatgctatttttagattgtctttattttacatattaggaatttgcacacacgtcaggtgagtcgtaagagtcacagaggaagttccttcttagcctgtggcagggtggatcctgcagctcccttcccccctcaccctccccccggggggcctcactcacacagcccctccggctccctttctttttatgagctttcaccttactctgttttcctcttttcttcctgatttccctaattgagtttgagtcagtgcattgagcgtgcgctctcagttgtcaggggtacacacttgtgtgtgattttttatgtggctgagatgcaccaggatcctgttgcctcagcccactgtggtctttgggtgcagaggagggttcttatgcccagccacttagccagcagggtagctgggggtgagtttcagaaccttctgaacctcaactgtctcccctccagggcaggaaggataataacacacatctaagcggggagggtgataattgtgcccatagtctaaatctttctcagatcctccggtgacattgccgggtggcctgagctaggaggaagggtgaggacttaggcagatggaggactgtgcatttcagttttttgttttaattaatttttttaactgacaagataacttagagggattttttaaattggcaaatagaatcttcagctttgccttcggttccctcatcgtagggtcagctcgtggctgccaccccaagacaacacttcctccccgtggccgccctgcggttcccttcttcccggagggtaccaacgagctaggcctggtgctgccgaaaaggaactcaggaaaaggttccaaaatttttaataggaagaatttcccaagtctaaaatacacagaacttactcaaaaagggccccttcttgtggatatttttaagagtacattttgccacgctgtctcgcgtggggcctctgcagcagctgagacgtttggcagtttcttcaagacttggagtaaaacctcgcctgagatagaatctaaatacactgggcttggatcgcccatttgactaaatttcgatcccaactctagctttcagaaacctccttatagggagagacctattgctatgggaaggcaagagaaattaatgtctgcgttattccagcaaagcccctgcactgcgctggagggacttttgtttgcgtctttgggttgcagaaggggctatgattgtgcgtggcttatcttggtctccagcccagtttagacctccttctagctgatctcttctctcacttgtactttggaagagagtcagggcttggctttgggtcaccaggcgtgcagccatgtcagagctctggagccacctcggttttgtccctgtcacggggattgactgattcttaaatgatctgcgcgaggcggccctggagcctacagcagcaccgttcccccagggtatcgctggcctgtgtttcacatagggtcagctcttcgggggttgtcactgagtagtaagtgctgagccctcctgtccctgtttgcagaggcagcggctggtttctggctggccagtgattcctccaccctgtgaacacacgtggaaattgacacggtggactctgggatgtaggggaaggctctgggtcaagggcatggcttctttatatagaaagaacaagtcagatggcaggaaagatataatggtgggtcatttaagtattggttctttgtaatttaaaagaatcactttatttatttatttttttatttttatttttttttaaagaactgagttttatgggtttgccacaaagccattctacatccccgacaagaataagaataggtgaggacccagcagtcgcatgtgaaaataaacggtgtatttagcgggaaactaatgcctcttgcagccatcaggcactgttttcccttgatcctggaacaccttggtttccggggatctcagccccagccgttgccccatagctgttcctcagcaccgcagtcgtggaagccctgtactgaattagaaccgagcagccctggctctcaaggggtcacggggtgagaggaccagagttctgcaggcattttcacgtgagaaactccagtcctctgtggctgtcccacttcctgacagcttggcttccttcaggcagcctgagtattattcccatcttagctctgtcggtatgtagtataaacacagtccatgttattgatagtttcttaggtaaaaacacattaatatttgaatcgggccaaggagcacggagaatctgaagttgtcgcaaacaagctggctgtaaatgggctcctccagggcaaggcacaccccagagctactgggggaggtggaagcttgctgtgtgttgtgtgtgtgtttcctgtggttgatgctcataagcgttacctccgtggaagaggtttacctttttaggaaagagttggttttctgcttttgcaaatttgtaccaactgttgatcatctcaaggacagtggagaagggacaggcaaggagcctccctttcagtcttggcattcttcgaaaatagaaggtggcttccttaaatgatttcccgacttgactcatcaatgtaggaatgcctgtgttgacactctcttccccctctctctctccgtctctgtccccatcccttttactttttattataggacagttttcaaccattctgtggaacagttgagaggatgataaagtgaaccctgtatatattaaatcacctacattttacaattatttgctctgttgttttgtttttgtgggtatgtttgctaaattacagacaacatgatgttttaccacccaaatacttaatcatttcttttttaaaaaactgacatttttcttataaccaaattatcttaactttttaatgtcttttgaacccaaatggcagagcccttgcaattagccttgttcccgtggaaggtgtattccattgccggccaggctcatgcatccagcaggcgcctaaggggctcctccgatatccagccagctctgacaatggggccgtagcccagaacaaggcagatgggattggctcattatgtgggttggcagaaagctccgatgaggtgttcatctgtatttctcttaccaatggaataattgtttttcctttttgctagcttgcttctgtagcacggagggccactatgaaatagcaaactcttgcacttaatttgtatcttgtcctgcttaccggcctagaagctcctaaatagagtaaacttttctgtacattacaaagtgcagctgtttaacgtttgcaagttaggaaagtcgcttctacttggttttcttctaataatactaaaaggcatactttttttttaaggcaaaggatctcactgtcacccaggctagagtgcagtggcacgatcatagctcactgcagccttaacctcctgagctcaaacgatcctcctgcctcagcctcccgagtcctctgaccatgcccagctaacttatttgtggagatggggactcaactgtgctgtccacgctggcctcacactcgtgtcctcaagtgatcctcctgccttgggctcccagagtgctggaattacaggcatgagccaaaaaaaaaaacacatacttttaaatttagttacaaatatcgcatgatttggcacattaatttcatgtggggatgtttagttctttgggttttttttaacctgctggattaaatgaaatgctgagagttgaagaaattggcttattttcctttttcttttctttttttgagatggagtttcactcttgttgcccaggctggagtgcaatggcacgaactcagctcactgcaacctccgccttctgggttcaagcaattctcctgcctcagcctcccgagtagctgggattataggcacccaccaccatgcccagctaattttttgtatttttagtagaaatggggtttcaccttgttggccaggctggtcttgaactcctgacctcaggtgatctgcccacctcagccccccaaagtgctgggattacaggcatgagccactgtgcccggcctattttactttttttttttttttgagacagagtttcgctctttttgccaaggctggagtgcagtggcgcaatctcggctcactgcaacctccgcctcccgagttcaagtgattctcctgcctcagcctcctgagtagctgggattacaggtgtccgccaccacgcctggctaatgctggttttttttgttgttgttgttttgtttgtttatttagtagagacagagtttctccatgttggtcaggctggtctcgaactcccaacctcaggtgatccacccgccttggcctcccaaagtgctattttaattgtgtatttattgccactctgagctatatttgaaaattccttttgtgaaaaagaatatttaaaaccagacacctccagcagtttgctgtatctctgtatgactaggttaaaatgcacaagtctgtgaaagcttcagtgacaccttcatcagtgtaaattctagagacttcacgtgccagctaaggtgaagtaagccacctacagcctctctgtcccgctcattacaaagaaaagctctggtcaggatacagaaaagcaactaccaaaggctaaaaatgagcagggatattagggactggagtcaaagtcagataaaatatagtgatgaatctctaaatgtaaaacattttatttgggaagcaagatttacagtcgaaggcatacaggcagaccaggtggtcttcagtatatcttgatgaacaaataaaaggttggcagttttaaaaagaggagaactgtttcgtgttgctctttgagaaggttcttcggcactagtgaggtttctggggagctggcaggttcccgactggtgagtgggtgaaatgagtcctcgaatcacagcaggttgtgtcggttgccattagtgaaaactggtttcaagtggcagcaggcagtttccgcggccaggctggcagagaactacattgctggaggaatgttttgtggcccgagtgctttcccccggccccttgactctgactgagttgggtatgacaagaatgacccagtttgtatgatcagctctcacagtgacaatgacagtcatgatggggatgtgttttgagggccttttcctctcctttgccgaggaactgcacagggaatgctgatggcgagacctccagggaagccacttatgtcttcaccactagagaaggggggactctgcatgttggcgagagcaggggggtgccacactccagcacatcgtgtgttcaccttctaaccgggaagctctccttgttcaggagttttcatagagcgtctgtccatggggagaggagtggctaggtggggtgggtggtggtgtcccggaaccagtcccccagggatacccagggatgactgtatatgcccggaccaagtcctgaaggtcatagcagaggccgcttctgcacagtggggtgggagagtgaaagttagactgacgcacttttgcgtgacacatgtctgtatgatttgggtttttatagtgaccgccatttgcttttattctaaaataaatcagcatgattcagtgttgtgtaaaagataaatatgaaaatgctaagctatctcaacatggtgggtttatacaaatttttcacttttttatggtaaatacatgtgggtttttttttaattaggaggaaacaaaggaattttcattctcaaaaatgaaaacagcattcaatagttatttgtatgatatttgacaaggttaccgagctgaacattaatttgttcttcattgttaaaagaaaactctaggcaaattgaatacaacagagtttaattgagcaaagaaccattcttgaatcaggcagccccagaaccagagtaggttcagagtgacaccggcactgccatgtggctggataccattcatgggcagaaacgaaagtgactccggagaatggaagagccgcagcagctggattggctaccgcagggggtctgccttgcttgagcccagttcgaacagttggctgcctgtggtagtctgagactcagctgcctgtcacaagaccaggctgtttatacatcaggttgggttacagttcaccatgtatatggaaccattaggccaaacataaaacatgtacggaggcagcctttaggcgaaacttaatttaacatcataaaaatcttgaagccacttgtttgcgtacccagcctggatccgtcacaattcttgcttcatgccacactcatcactagtccatatttggcctccttttaagcagttaattaacaggtatttttatagcataatgggtttcctcaaaccaccacccaaccaaaacccagcccttgatgatgacctgcgcccaccacgcagggcgcccttgatgcacacgcacctgccgcccccgccctgtgaccaccgccctgagtgccgggctcatcatcccttccatgccctttctacattgctactatgcatctgtgtgtattcattaagaccattacttttctttcagattttaaatttattaaaggctttagtgctgaatgtgattttgaggactcttttaaaaaaatacttttggttggaatgtggacatttcccacttagcattgtgttgctcatgttcctccatattgatgtgtgtttagctagagtacccccgtctaactctgcgaatatgccacactgtgtgcacctgctactccttaatggacacttgagctttttcagcttcttcctttatttgtttgttttgctttgctttggtgtattgtattttatttttgctattaccaacagagatactttgaacattcttttctgtgtgttcttttgaacacatgcaagaatttcttatatattgaaaagcagagttgccggatcatagtgtataggaacattcagttttaagggatcatggtaaggtgctttcccagtggttgtgccattttacactcctacagtggtgatggagacagcctatgatccacatcctttctagttcttggcattgccattcttgtacatttttgctgagtaggtttagaatgatatctcgtgtagcctggatttgcgtttctctcatatcgcatgatgttgaacatttcctcacgttcagtggccatagttatgtcctcatctttgagatgtctgttcatccatttttctattggatttttaatgctcttgtggatttatatctaggttttcaatcctggttatgatggatattgcccccacctttttgcttttcattttaggacgactacaaatgttaacaagtttgtgtgtcatcattacttcatagatccccttcagcgtctcttggagttttctcccctctaactttagcttgtcatctgaaagtgtcttcctcatgagtctttttgtgacaagtcttctgaggccatatgtgcctctgagagtatttttgtcatgctcacacatttgaatgacagtttggctggatacaaaattctaggttttagcttccttttcttcagtaaattaaaaacaccagctgggggtggtggcttacacctgtaatcccagcactttgggaggctgaggtgggtggatcacctgagttcaggagttcgagaccagcctgaccaacatggcaaaaccccacatttactaaaaatataaaattagccgggcatggtggcgggaggctgaggcaggagaatcacttgaacccaggaggcagaggttgccgtgagccaaaatcacaccactgcactccagcctgggtgacagagtgagactctgtctcaaaaataaataaaataaataaataaaaataaaaacaccacttcattgtcttcctgcatcctgtgttaatctgataaaaataaaaacaccgctccactgtcttcctgcatcctgtgttaatctggttcttgtttctttgaatgtgatctactctttgtttctggaagctttgtatgtattttcattgtctttttaatattcttgatcttcactatgatgtacctaatttatgatgttcttcctctgtatatcataagacctcacagaatgtgacgattaaaaaaatcagtataaaagacagaacaatggtcgccaaataataagcactaaataagcaacagctgtgttatattatcattatattcagctttgtgggttttttgagccatttttattacctctgcctttgcccactctttgacctttcattgctcagcaacactctgatgtaggtgaatgaaagaaatcgtataaaatgtgaaaccagttgttagcaattctggtataaagagaatttacatttttggctaaaatgaagtttgcatactatcagtgactgatatatccatgctacgcttattcatatagccatgctataataaagttgcatgatattcccattttaattttttatttaagggaacattatattttcactgaatttataatatgcttatctcccagccaataattatttttataatgtgtaagtctctgtgtactaattccaatatctggccaactatgaatctgtttttattgacttttttctcttgattttagatagtatactatctgttgtggatgaggcattgtagacattctagattctgttattttcttttgggcaattacactgatcttgtagaggcttcgttataggactaggctcttttggctttgatcttagttctaaggtgtggttcataatccctctggggtgtccatgtcctcagatgtgatcaagccctgtagtttggcaggacctgatcttctctgtcttcacagtggcaagcagatgtcaaaatctctactctgcgttttcaaccttcctgctgtcctccacggggatcctgggaatattatcctgtgtgcgtgcccttcaggagccagcctccgactcggggaaggtttacatgagggttttggctcccttcttcctagggcttttgcctgcaatatccaggcagccttgagcatggtctcaacccagtaaggctgctgcctttcagtcgcatgctaacccccacatgacttgtgagtgaggagcacccttgggaaaagccagatgaaagtgattcatgcagagttactctcattttctaagggtcacggcccttccatttcctgccttcctgcctgcatttgtttgttgttcagaattttcaaatggctttttaatattttgtccagagcttatcattattggcaaaaggatgagtctgatataagtgattctgtcattactggactctagaaatcccaatcagtaagtacattatggataaaaagacaaagtagcatggttcgcataggactcagatttgaaaatgcatttcctgtagatcatttttatccacagagaaattctggtttgcctgggaccaccgtaggagctgcatgtgtctgtgctggtgcagaggtgtctgggcatggctgaggagagcatctgcaagtgaagccagcagaggagaccactcagagtggcactgactggctcggggaagcactggggccacacggggcacttgatgccgtgggaaagggctgctctgtagcttcaggcaaacgtgggcctcacttttattttctcagctctttgaacgataaaacactgactactgcagccacaaccaagaatataacttcctctctgctggctgagccaggtatcacttcttgagagagtgagtgtggctggcagccatgcatggggtccaggatgaccagctcagcctcccctcgccctgcagggctgcaaaagtgagactgtcttcacacctctggctcgttgtcttcctggttctggatctctcagttcctctgtgtctttttctcccatttcctatcccactgctatgggtaccctcctgggtccaccatcccccatagaggagtcactgccacgtctcccccgaacgtgcctgacccttgcactgcaccctcccctgggccactgtccttctccatcactcacttccagccaacacttctgccatcactcacttccagccaacagtccgcgagtgtgttttggagatgtgcatacttgctctgcacctgccattatgtttttaaggggtgttatttgttcttaattttaaaagtaggtgaattaaacattttgcatttctcctactaaaaatactgcattgcctttttactctgctgcctcgattctgcccactgtatgccagtagcccggatgggaggagagatgctttcctacctcctgttggcgccacgttagagaaagcctgtccggctccacacgcgctcctaaggatggacctgcgtcagacatgaacccagctctgacctgtaggattttatgattatgaacatgatataattgaatttgcatttcttttgtgtgtcttgaggctactcatttattctactccagcagtctccccagctcacttccttaagaaggaaagaagtggcaggtccagtccactccagcatctcgtttggagactgagctttattaagcatctcggcgctcctctccagggaccgggcttcatgtggctgcaaacggcttctctcctttctcctgacaactcactgtggcagctctgtagtctcacgccttgacagaatggcaatgagattttctttacaaatctaaaagctgccgaattaaggaaatctgagtgtacttgttcaccgtggtagtccctgtccccacctttaactcttccctttttctgcaggcctgttgaatttcctgggtgactgttccattcatgccgttcacattcttttctttctctgcaggttttgcatgcagaaatgtgtcagtctggtgcctggcgtcacactggatttgatagaaaagtaagtaggatttttaagctcttgtggctctctggatctgatgagtttcttttcctttttgaaggctcttgcttctcagaagtactttctatcaacatggcatgttccctttcatgtggctgtgttcttttgttctctgattaaggctgtgtttgtgattgtcacactggggcttagtgcaggagataaccaaacatgggccatatgaaaagaaaaataataaaaagctgaattcctttgaacatttaaaaagtctccagactttaagccaaagcaagaacataccacttcgcatacaaatcatttctgctgccactgaaatgatagctagatcatagctagctcttaccttattttctgaaactgtccctttaatattctgtaactttccatcccctccccccctgtcgccatccagtttccattttactatctcagggcaaactgatttcagaacctgagcgatgaagtgacgggatttagtcaggcctatgaagagtcaatggcacttgcctcccataatccttccagtcccattggccaacccgtctgtccctcgcgtgatctttttggatctgaagtggtgtttcaggacccggagcgtggcctgcactgccttgttctgtttgtttgtgcaccggattcatcgtgactcatcctgagtcatccaggcagtatggaagaactttggagttattttaaaccctttggctcagaaccccatttcttctagaattaacatgcaagataattgttttctacatcttaatatacaaagttatatcttaatattagggcctgaatttactaaattaggcaggaaaagcaaccccacttccaagtttctcttgtaaaaacgtgcttgccttgtgtatcaggggaaaaatgcaagaatattatgtgtaaacgttcatgagggcacggtgagctccgtcgtggttcactcccaccgtggaaggtggctgtgtggccaacaggaaggccggggaagcgacactggtcctgatgtggagtggtctaccagatgtgctaagtgagcagtcctcagcatgggtacctaacagagctcagtgcccagaggctttccaaacagtgcaagctgtgacttagaagactgtttccaaaggctaaacagatagtggaggctctcagaagcatcacgtggaaaataactttaaaaaaaaaatgggactagatgatctgtgctcccctccccttctggttggtttggttccctgacgagactgcagttttgcgaagctgttcttgagatctgtttactggtattgctgtgcgctttctttggggcttttatttccccctctgttttctgagttttagagctctctattacctgtaacgtatatattgcccccgccacccctgcgccctccccacacacacaccggatgcgtatcccaaatctaaaaatccaaaatcaggaatgcatcaaactgtaaaaaaatttttaatgaattaaaaaaaaatagggcatcttgctgtattggccaggctggtcttgaacgcctggcctcaagcgatcctcccacctccgcttctcaaagcgccgggattacaggcgtgagtgattctggccgtgccaggccaaaatcggaaactttttgagcactgatgtgctactcagaaacaatgctctttggagcattttggacttcatgttttcggattagtgataaatccaaaaaacttaactggtaagtataatgcagatattccaaaatctgaacaaattcgaaatccgaaacgcttccggttccaagcatttcagataaagggacacttaacctgtgtatatatattatatatctaatttcttaaataaaccatatccattaatatttcagcagttatattttatccttgctgggttggcttattcaggcagctcttgggtgaaaactgtcttggtgttttctgtttgtcgtgcctccctgtggctatttccatggtttcctctggaggtgggagggccgcagtatcctttctcctccgcctggtagcaggagcccaagccttacccacgcctccatctccgtgtgggacagtgtctcgtctccatcctggatggctgctgtgtgctgtcccatcccccctggtcacctgtgtctgtggctactccggacagagccccccggtcacctgtgtctgtggctactccggacagagccctgccagcgcgtgttgagccacatgagctcagacagcgccacaagctccacatctctagagcaaaaaggtctgttaaaaatcacctagtgatgacaacaaaaatttgttttaggttattgagtcaaactaccttattttactgagagagaacctggtatttagttcacttcagctcctgggtggccttttctgcctggttcgggcagggctggcctagagctcaggtctcaggacagccccactgtcgtctgcccaacacacggaggttttcccttgaacaagattttggtgtcagaacaaccagctgcctccctgtttctttccaaaacttaaaatgtgcacagcaacatgacatcctaagcatgattcacaaaagaaaaaaaattggtaaattggacttcatccaaatgtaaaatgtttactctctgaaagacacgctgatatgaaaagacaagctatagactcggagaaaatatttgcaagtcacatatctgacaaagaacacatgtatccagaatgtataaagatatctcaaaactcaaaaataagggggaaaagaaaattagaaaatagaccaaagacatgaagagacacttcaccaaagaggatttagggatggcaaatatgcttatgaaaagatcctggaaatcattagccattaggtaatgcaaattaaaacacagtgagacagcactgtccctattagaacggatgacatttaaagactgaccaaacgcagtgttgagaactcacatcacagctgctgggaatgcagaatggtgcggccactctggaagaactgtcggtttctcataaatgtccataaacctgccaacatgtccccgcattcctactcctggatatgtaccctggaagagggaaatcttaggatcacacaaaaacctgtgcgtgaatgtttacggtagctctgttcattaccccaagccggaagcaaccaaaatgtccctcccagggcaaatgaattcagactgtggtgcatccgtatgatggaattctgctcaacaggaaaaagggacaggctttctatatacaccgccatttgggcggttcccagaagtatcacactaagtgtcagaagcccatctccaagggtggcgcatggtccgattccctttctgtgaccttctgggaaagacagaacatggggccagagaacagatcagctgttgccagggattagaggggtggagagtgtggctgtgaggggctagcgggaggggcctgggggtgatgtcttgatgctggtgtggttccacagatccacccacacgttccaatccatagcatgtgtacctgcagaagtcattttgctatttgacaactgaagtaaaagtaatacataatgtaggggaggaaaaaaacaccacgagagtgagcaggccggagagtgcagagcagatgcagcacacggctggccaccgctgcggacaacaggccatgggcctggggagcgaggggtgcagggaaacagagacctggatttgggaaaggaagtggattctacagcagcatgctctgttgtttctgggaagataccttcactcttattattaaaatgggattgagtgaggattgaaaaagagaagcaaacacccttccccatccaccgtgggatgttagtcattttcatcagacgccctttccctaaatcacgatgttagcgtttgcagccactcgtgttcttcccagaaccagtgcatcccctccctccccagcaccaaaggcccttctcagccagtgcgatcagacagctggaggttagggcagtgttctcgtctttcttccatctccccttctcctgtgccaagtgatgctatgaaggtggctaaatgctaaaggtttattttttttttttaatttaaaagagacaattaactgttaatagtaggcagttttcaaaacacaccctgattagggattcggggtacgaggaggagagtgtggtgggaagaatatggacgttggagtccgagcagctccatctggccctcctgaccccttctgagccacactcactgggcacctccttgcctctgggtctgtctctgtcctgcagaatggacaccactcggctctcatcgggcagcagcagtgccgagggcatcacacatcctgacacgaccttggctctcagcccgtgtccgcctcccgccagacacttctgccttctcagcacttcccagagctgcagcttggatggtggctgctgtcactccacattcctgtagttctgtaagcgtctcccacgcctctccatctgccatcagctgaggcacctacgactcccaggcatcgttgccctggccccaccacagttagagagagatggcaaggcgccagagaggccgtgctctcgaggcccattgctgagacaaatggcttagcaggctgttttagtccattctcacactgctgtcaagacactgcctgagactgggtgtattagggttctctagagggacagaactcataggatagctataaatataaaggggagtttattgattaatattaactcacacggtcacaagatcccacaataggtcatctgcaagctgcggagcaaggaagccagtctgactcccaaagctgaagaacttggagacactcagtattaaccatcacactgggtaatttataaataaaggaggtttaactgagtcacagttctgcatggctagggaggcctcaggaaacttacagtcatggcagaaagggaagggtaagcaaggcatgtcttacatggcaggagagcgagagcacaccagggaaggggaagtgccacacttttaagccatcggatcttgtgagaactcactatcacgagaacagccactcccataatccagtcacctcccaccaggtccccgcctcaacacatgggtattagagttcaagatgagatttgggtagagacacagagccaaaccatatcacagtcgctgtagccacctcagtctttattgagaataacttcttaaagtgtgtggatttgggtctgagtcactgttctctgaatgcagttcagcaaaagcacctgttttagtgtctttcactaagaatccacgtcagcactcacagggtgaactcccgtggtgcctccgcctcacagtgtgacagaggttaaattgcgggtggctgaattatatttacattttttatgccaggacaaattccaaactttagaattatacagcaatggagaaatccagatctttgctccaaaaggtgcccagccacagctgccattagctctatttccaagtggacgtcagtttttaacttgcatagacacagtgacttctccgcttaaaaacgctatttttatgtttttttaatttttggattttgttccccaattatgtttaaagtctcataagaaaagttttttgtttgtttggttgtgtgttttttgttgttgttgtttttccagacagggattcgctctgctgcccaggctggaatgcagtggtgccgtctcagctcactgtagcctcaacctcctgagctcaagtgatcctcccacctcagccacccaagtagctgggactgcaggtgcatgccatcatgcctggctaatttttattttgggttgtttggttttttttgtagagacagggtttctctgtgttacccaggctggtcttaaactcctgacctcagatgatctgcctgcctcggtctcccaaagtgctgggattatgggcatgagccgctgtgcccggccatgtcttttgcatattgtattatctacaaaggacatgagttactttttaaataagtgatcttgttaatcaagtgatcttcctgccttggcttcccaaagtgcttggattataggcgtgagccaccacgcccagccaaagaaaagtttttaataagtagatttgattttgcagttacaaagtgaggcagaaaattcagcacatctatgtttaatagtgtcttccatgccgctgtggtttttacagtcagaggacactcctataaaaaatacctcgttatttttatactttatcattttctgaagatttattcttgaaatatgttgatcttggttactgtgacctctgtggctcagaccctcttggccagcctttctactacctcagggcccctttttcccacgggggtcccaccaacatatgttaactcccgtaacgctagcccacgtgtcaggggagacagatccactcggaaagcagccgtgcggtacagttgagagacaaacagatcatcatcaagctctactgatgaatgcggcccctgtgttccaggcagccaagactgagttcccccttatttcccttcactgaacatgtcagccatgtttgtgatgttcttgtgtgtcccttgccctgagttgacgctgggaccagggtgcttgaggatgagctcccagcaattccaggctgtgcctgtcaccaatgtgccccgggcaagggagtcacctctctgacatggaagcccagaggttaccttctggaagcaaaccctgtaaccaacttccctccttacagggctggaagcgtagcagtgtccaccatctgtggaatgtcctctggagccgccttgcccatgccacacagaaggacaccacggttagggcacccatgcgtcacagcatgtggccagcagggccacgccacctcccagggaggcatctgacatgcacaaaaccttttgagtttttgtatgtttttttcaacactttcctaaaatgcagtgatcaaaagttagttgcctgctcctgcttgggacaccagtccctcagggggtttgggaattgttcctcccagactccggggctgacatttggagggtcaccgcctgacccctgctccagagtcagcaggatggcgctcctccaacaccactcctcccatcgcatgtgggagcaggaggggtgtggtcttggaagcgacaccctatgatgcgcattcacctgagtggccttcctggccacagggctgagccaagggggggccaaggcactgcctccctccaggcagcacgtgtgtctaaaaaatttatttataagtacccagggaatatttaaaaatatataaatttttgaatagttgagagattttaataaaaacgtttgtgcattattggcagagctgtcagtgggtgctgggtgagagccacacggttgtctgggtgacacccccgtgtccctacacaccatgactgtcctcctgtccacctgagatggaactctgggttccctgagtcacacctacattaaaacgtacacagtcatccatcacgttcacatctgtgccggcatgacctccctggggaagcgtttgcattgctgccctttttgccaagaccctcccgagcgtgatatgacctttgaacctagagccagagaacctgcttgggcgtccctgccttcgttaaatgaactgatcttggatccaggttaatggtgagataacttgtttttaattatagttttaagaccaggcagaaacaggctctcgtgcttagtctgatttcatttacgttttagcagttcattattgtaaacagaatcctaaggactgtagaccgggggcgtggaaaccccaccacaacacagcacctagaacacacgtgtgtgacatctcgagtgacgcacattcggaacagatcgtgtggatgtgcagatgtcagggagtctgcagtacctgcgcatacactagctggggctggacttgatctgcttttagcttttgccagctttttagggagtctgaagacctagtttagctgtttcattcttttgtctcaactcaccacatggaaatttcttgcccttgagaatacctctcttgccactaagtgtgaggacgacgttggttcctgggtcccacctgactagtgtgacgagtcacgtgacgcaaggagaataacgggcctgtgttctcgggctttttgtttccgtcaagcttcatgacctgcaggaagtaaaaccaggtctgcctcacgctctgcacacccctcccctccctggcggccgccctgcacaccccttccctccccagcggccgccctgcacaccccttccctccccggcgaccctcgttgggagcgtgtgaaggatggtcctgagtgcaggctgcaggtgccaggtggtgatcggcacataacgtgacagatgggcaggtgtgtttgtcacgcacagacctgcatggtaggcacctgccccatgcccatgtgtccttgcccgctgccatctgagaggatgtaccctcatcctacaacagctggcccttggtgtgccaggtctgccaggccagagctctctaggggtccgtgttgggtaagtgcacggcaggtggccccctggccgagagcctcaggaccccgctgtctggggtttgggggctgagtgtggcacagcaccactttcatgccctctggaaggcttggcttttgcgacctggcctcctcaccagctcaatggcagtttcatggcatagcgtccctgctgcccccagacggtcagaaatccaacccgagtcatatcattatcctcgtctttgtcggcactggagacgtggggaggtttcgttcctcagaactgctgcacgatatgtcttccaaaataaatgcggtttatttcaaacagcagcactcaaaatcaaggctcctcaggaaatccagtattaaccccttccgagctttcgccgtccttgtcagatgggcaaaacacgttgtttagcatctcagcacaagactggagagaagatcgggcagtttgtgcataattatttagcagtctttaaaactaggagaggaatctgttttctaattaagctgctgtgtctggaagtaaattatagtgaaccttcctcgagcgacccccccagtttctaattatctatgctaacctagcagcctgatgaataagctgttgctgctgcagtacatatttatattctgaatcctttgagagagtggcaataagatccgtgcctggaaattaagggacatttttcagccctgaaacaaagtaatgcaacacttaaacagtgctagaaatattagggttttcagaaagctccggggaacctgagagatgtgaacctgttccacgaggctgctagttagtattctgatcactggaggctcaaagcgtacccagaacttactcgtgattaacattgattgtgtacacagcatattttaaaccgctaacaatccattgtcgtgaataagtgagtctctgtgtgctgctgcttccgaggctctggtagcacggctgccccgtgtggcccagggacagcaggtgcggggctgcagccccacagccctggagcttgggtttgactctggctctgaaaccttcagcattgtgttagctgatctctggttcccatctgtgggacttccgtctcatctgagcctggggatgcagtgcagaaaatgtaaggagacctgggagctgctgcttgagagcacgtggctatccgtgcttcctggggaatgatagtgaccgtaggaagcatttactgagcccccatggtgccaggcatcgtgctgaggcctttacaaacattacctgtaagtcctccctggagcccttcaagggtgggtgctgttgttatctaccttttaaaagatggggaaactgaggcacccagcaagcacagggcctgccaagcaccacaccattaggacaagctgggacagggatttgctggcagcctccctggagcctgcatctccttcccctcggcatgggctgtgtgaacagagcacgggctcctcaacaggagcccagacctctagaaggtctgcacagggtttgggggggcagcactcgtgtcagaggcacagcggctgtgattagaattcacttcatcgagggaagtcatacacatggattatgtttgaaaggaaaactatcaaaagatcccagtcttgattcaaaaaatacctttctttccaacataaatatacaatattggctggtaaaggtgaaaatcagtaattcattaacgtctgccagtcactgctgagatgagtaacgaggcactagacgctgatttagaaatgaagaggtggaagcaaaacccgagagatcgccgagcgagggggaggtgagtgattggcggaaacgggggaccgccgccacctagcagatcacccctgcctgcccgagcacagccacctcagcgttcccgtgcgcgccacgccagggcgcacggtgctgcacgggggtccttatgcccgggcgcctctcattaaggtccccccacgggcagagggaagacgggcaccgggtccccttcgtgttcgatgtgcaccccagcaaggcctccttagctcatccggattggtaggggtggaggaggcttggttctgagatgaaattgcagacgtgcagccaagggggaatgtgagaggttcagaggccaccccagggaacctgcacacagcacggagatcttccgtttccttcacagtggtacccaaaccctggtatttgtcatcaaaacaaaggcctgcgccacagagcacggagctgtaacatctgtggcattcgctccacctcctcacggctctgcacctcccagcatcctaaagaaaacgtgggctgggcgcagtggctcacacctgtaatcccaacactttgggagtctgaggcaggcggatcatgaggtcaagagatcgagactatcctggccaacatggtgaaaccgtctctactaaaaatacaaaaattagctgggcatggtggcgtgtacctgtagtcccagctacttgggaggctgaggcagaagaatcgcttgaacccaggaagcggaggttgcagtgagtgagctgaggtcatgctactgcactccagcctggcgacagagtgagactccatctcaaaaaaaaaaaaagaaaaggaaaagaaaatgcatgtgtctggatatctctaaaggaagccctcgctctgcggagatgcaggagcacagcttgattggagggcagcttccgttccttgaaggcaggctcccaggtgcagagcgaggaagaggccgcagtgaggctgagcgtgtgcctggtcagtgccccttggccgtcctttctgatgttggcctttgctcttgtgtaggagtcatctcagacggctcagtacctatggaggcacacgtcactgcggtcgcataaccgggatgaggctcagcccccattgatgcctcttctctagacgcatcgtagttcagcaggtgcacctccctccgtccagtctgccatttctccttaaccttccctgagagtctgttgctccagctccattgcccgcacggcccttcggttcctcacaacccctggttctggtggggtgcctggagtgcctcctctggcaggggtgcctccttggatctgtttatcctgcaggattcagtgccctgccgttgttcctatgtgcgtggctgcagacttgcaatcggtgataaagcagtgtggcgtgaggcgccagcataaccggggaccccgggtgtgtggtggcttttccggtgctcatcacagccacccggcgagcagcctctgaggccatctccatttaaacttctggaaaccgaggcaagggaggtggagagacttgctcagggtcacagagagtcacacgagggtcccctgtcggtggcggagcctgtgtccgcccccacccgtcctgctgtgtctgcccccagccgccgctgctggcttctcagtttgctgctccgtgctgcacagtcccctctgtcagagcctggtcgctgtgccctgtggcccttcagagaaaggcctccccgttctgatgtgcgtgtgttgtcttctgacctcgatgccagtatgttttgcgtgagtggccagctcgtcagcggggcctcgggttccaggctcgagcgcacttttcagaccccgcgtgtgtttctcagcacgtttgttcattcaccgttcattcagcagacatctgctgcggactggctgtgtgctagggcctgtccgaggctctggagccaagtccttgctcgttaacttacatcctgatcaggggaagaaacgcacataagaggagtgtgaatgtaccaggagagccatgtgatcgcacacaagagtgcctggatgcttctttgattgggcagcctgatgaggcccatgaagaggcaacactggaactgagaccacctggccagacgggagcagccatgccgggaccaggggcagcgttccagacggggagccccacagcctctgagccaggcacgagcttgggctgtgtggcaagggccttctttgaaagaggcatatgtagcttcagtatttataattaacaccgctaacctggcagcacttaatgggtctacaggggcctgtgtgagtctgactcagaccactgcatcagatggggaaactgaggcacttaggagcttgatggctacctacagaggacattttgctccatgaatcagtggcgtgacccgcagtggccgcagaaggggcagtggcacaagcctgactagtggctccgtttgcagagggggtgggggcgactgacggccagcaggagggccgtggtgttctcacctgagaaggcgggcgagcactccttttgctagaagaggctaagagatctctacgattatttccatggatgatgacccaaacagatttagtgtggctgcgtgtgtagctgctgtgtcttctagctgtttctggagaccagaatgtgcctccccgaaatatgaagaattgttgggctgaagacaattaagaagcaagtgcaagagagctcctttcctgccttctgtttccctaaagcaaaacatagatctacagagacaaaggcatcctgtcccgccccgtcccagggaggacagcagcaagccccgaagacagctccaggcccacgcgaaggtgtttccttcattttctagatgaagtgactgagtctcagagaggttaactcacctgcccaaagtcgcacagctaggagtggccgagcctggaggacagagccgggtctgtgtgatgccacccccaactctgcatcggctggcgtgtggaaggacgtccatcccttcacgtccctctgcgtgtttgtgagtgcgattctgaggaaagtggcatgagttttctgcatcaagatgcctggtctcaaagggcgggttccatgtggacctgacaaaatgaggggatgtgtacagcatgggaggagagaccggttattttgacccaagccccgggtgcccagtggtaggaggagtgctgaccttctgtgtgatgcatgcccaccaggaaaacctcagaggattatcccagaaatcaggcataaccacacaaggctgcctgtatttggaaactgtctttcctagggtgttttaacaaattcacaggaagacacaatttacaaccaggctaggaagtgactctgggatttcagcatcttttcagagacagaaagatccagatgagctcaggacagtcgggggaaggtggtggcaatctctgtcagaaccgtggagtgttcgttgaagatacttccacagcaggagagctccacgccccatcctggaagctcaccctcctcccctcccaccctctttaggccagatttttgcagagaagctccctgatgagatgcagcgtgcaggtgagagtggcgtctggagacagcctggaggcggccagtgcctccggagggaagtgctccccaaccccggctctgctggagcccgtcctgcttccccttattttaggagctgcttttctcgatgtggcaggcctttcagcagcttctcaggagactctgcttggaggtggcttctcccatgtgactcctgcagctgcctctcaggaaaggtctgtctgaaggtcggccctgacaccgggaagcccacagaaaatctgttttgcagaagtgcttcaaaaataaacatgggctcagatgtctttctgatgggctttggaatctgcctgtttaataaaaaagaatctgcttttcattatgtcatcaacatgttgaataagaaaatggggaattacccctcgcctcgctgtggccccatctctccctgtggtttttgtttgcagcctccagagtggccattcctgtccattgttgttgttgactgactccaggaaggggcaataatttgtcgttctatagtaagtcaggtaaaaggtgaattatctcctgtaatattaactctgcttactgttaagtcagggaaacttcctcccgagttcaaccctacatttacttcacaagtaaagatgagcagaagtctgtactaggggaaccattaaatacggaaggacaggatccaaagagatggcagcactgtgcatatgaaccatgtgatttagaaaccgagcagagatttttaaaaatcattaaaaaacaagccgcctctggtggtttttaaaaagccagtcagcttatgcaggggtggaattatggaactttctagtttctattgtctctcgggtgccatgttcactccaaaccatttcggtaaccctgagccagtatatcctcctggagaaattaacaactgcttcctttaagtcaatgtttttcaaagttcaagtcatggttgattagtggctatgaaaccagttaggtgggtcacagccagcattttaaaaaagaagaaaatgtcattgttttcatagtaagataagtgttccgtggtcctgttgcttgaacatgtatctcttttttggtttgcttttttgtttctgttgtttggaggcatggacagggtacgaacctgtgaatatgtatctttatatgtggttgtgtatgtgtgtttgtctggtcaccaaaaatattcctagggctcatgatcaaacaagttggaaagcttcttatttaaatgatctctactcttatgttaattggggacctagacacactgaccaccttaattgcctatactttagttaccatcagtgttgtgaatacttagtcgttttccaagaacaaccttgccccaaatccctgctctaccatcatcagccttgtgccatattatggtttcctataatctgtcccatttttaattaggaatattgcttatacgtatatcttttttctttgattttttcttttttttaaattctcttttgcttatacatatatcttaacagcctcttcttttcttgttgaagaaataattttgacaagtttttacattttactttaaattaaaaactcatttcccttttgaccacatgcattaaccctcagaactgaagaaggccagattaaccgtaccaactcacccttcttgggagaatgaagcaaaccttttatcatcaagatatgtcaccctttatctctggtaatgccttttgccttagagtccacatttttaaagtatcgtagctgaacaactgtctcttggttagtgtttgcagaatgcatcttttttatccatatgtatataaggtagatctctttttggcaatatagttagcttttatttagttttgttttaaaatagagacagaacatttttggttttaattaaagtatttagtttgtttacatttagtgtagtaattgatatatttgggtttaagtctgcctcctacttgcttcatcctttttttttcctgttgctttttattctagccaccccaccacccttttttttggagcggggggaacggagtctcactcttgtggcctaggctggagtgcaatagcacgatctcaagctcactgcaacctccacctcccaggttcaagtgattctcctgcgtcagacttccaagtagctgggattacaggcacacaccaccacacctggctaattttttgtatttttagtacagacagggtttcaccatgttggccaggctggtcttgaactcctgacctcaggtgatccgcccaccttggcttcccaaagggctggggttacaggcatgagccactgtgcccggccaagccccttttttttttaacttttcttttttctcctcccttaccatcttttgagttgatttagcaattttattacacctttcttctcttctgttggcttgttaattttatattctttactatactttgagcatcctgttttttccattaactgccagatagtatatgccttagactttgcaggccatgtaaggtctctgtctcatagtcttcccattgttacaactctttaaaaatgtaaaaaccattcttagcctgggggccttaagaaaacatgctcctggctggatgtggtccttgggccatagttttggtgacctgctttagaaactataacgtgcatcctgctaaaaactaatctaagcctggcacagtggctcatgcctgtaatcttaatgctttggaaagctgaggcaggaggatcacttgaggccaggagttcaagaccagcctgggcaacatgataagaccctatctctaccaaaaaaaaaaagttaggcatgatggtgtgcacctgtaatctcaacactttgggaggctgaggcatgagaattgcttgagaccaagagttcaagaccagcctgagcaacatagcaagaccccagctctacagaaaaaattaaaatcagctgggcctggtgacatgcccctgtagtcccagctgcttgggaggctgaggtgggaggatcacttgagtcccagtggttgtggctgcagtggctcgtgatgcaccactgcactccagcttgggtgacagagcaagaccccatctgctaaaagaaacaaaaacagagtaccctttagtacagatctgctgggaaaaagttctcatttttatttgtttgaaaatgccatcatttctcctttgttttcacgttttcaaatcagcgttcttgaggtgcattcaataaaatatacccacttgagctgtacaactgatgagtttgacagaccactgtgcccgtggagccacaccacagtcagcgtatatcccgtgtgtccccttgtacctgtcccagttaatccctctccttatccctcaagcccaggcaaccattgatctgggttttctcactatacattcgatttgatgtttccagaactttctgtaaacagaatgataaagtatgtgctcttttctgtctcttccttggctcagaatcatgcctttgagatgtctccttgttgggagtatcagtagtgtgttcctgttcattataagtaacagcccgtcaccctgtgtgtcacagtttgtttcacctgttgatgcgcgtttgaattgttcctgtcctgactgttatgaacaaagctgctgtaaacattcatgtgcaagtctttgtgtgggcatatatattcatttctcctggataaataccggagagtgaattgcttggtcatatggtaggtgtgtgtttaactttataagaaattgtccaactgttttccaaagtggtttgctgacctgagttcctgccagtaacaacagcgtgccagttgtggcgcatccatgtcgacacttggcattctgccttttcggggttttttttattttattttttgagatggcgtctcactttcttgtccaggctgcagtgcagtggcacagtctcagctcactgcaacctccgcctcccgggttcctgcaattctcgtgccttagcctgttgagtaagtgggattacaggcgggcgccaccacgcccagctgattttttgtatttttagtagagatggggtttcaccatgttgcccaggctgatctcgaactcctgacttaagtgatccacccacctcggccacccaagtgccgggattacaggcgtgagctaccgcgtccggccatcttaccgaagtataacacaatatcattattattttaatttacatttgcctaatgatgacagagcagcttttcctatgctgctattggccattaatttatattctttaataaaatggatgttcaagtctcttgccaattttcaaattgtggtgtttgtcttcaagagcccttcatgtgttttggacacaagtctttgtcctatctatacattgtgaacatttttgctaagtctgtggcttgtgtttttatttctaaaacagtctaggccaggtgtggtggctcacgtctgtaatcccaacactttgggaggtcgaggtgggcagatcacaaggtcaggagatcgagaccatcctagctaacacggtgaaagcccgtctctaataaaaatacaaaaattagctgggtgtggtgtcacacacctgtactcccagctactcgggaggctgaggcaggagaatcgcttgaacccgggaggcggacgttgagtccgtccagcagtgagctgagatcgtgacactgcacttcaacctagacaacagagcgagactccatctcaaaataaataaataaataaataaataaataaataaataaataaataaaacagtcttttgaagaacagaagtttttcattttgatgaagtccgatttcatcatttatttattttatgatttgtactttctgtgtcctacctaagaaatctttgccaaccctcgggttgtgaagattttctatttttttctaaaacttttagttttaactttcatgtttatgatgaacttagtgaactatgattaacttttaagtctgcgatccgtttcaagttgttttttaatatagtcaagagtcaaggatcattattttccatatagataccaaattgttccagcactgtttgtggaagaggctatctttttgtcattgaatttccttggtgcctttgacaaaaatcatttgactataactgtatagttctattctattctcttgatctgtgtgtctatctttattggcataaagataggaataccacattaccttgatcacggtagctttattgtaagtctctgtttttgttttgttttgttttgttttgttttgtcaaaatggttttggctactctagatccttgcatttcatatgaatttaaaaatcagtttatcagttctaacgagaagcctgctgagattttgactggaattacattaaatctagatgaatttgaggagaattaccatcctagtaatatggagtcttctgacccatgcacatagtggcttcatcttccataatcatcacatactgatttagttgtcttggtgccttggagctttatctgtacatatcttgcaaatattttgttaaattaatgtcagtttaaaaattatttaagacagcatatagaaatgtaattgatttttgcatagtgacctcatttcctctaactttgctacattcacttattggctctgggagctgtttgaaaggtttcttaagatcctctatgtgtgtaattatgtcatctgaaaatacatacagtttgacttctttatttccgatgtttatgtctttaatttctttttcttgctttgttgcactgcgtaatgtctccagtataatgttaaatggacgcaatacagctgggtgttgaagccctgatctgagtcaaggatcaatgacagggaacattttatctaaatctactaagtataatatgtgctgtgaatttttcatagatacccattatcaggttgaggaagtgcgcttctagacctagttttctgagagtttttctcgtgagttcttgttggaattcgtcagcggcttcctctgtgtctgtggaggggatcgtacagctgttcaccctgttcagatggtgcatcacatgaatgatgttcagatgttaaacagtcttgcatccctgtggtaaaccccagctggtcatggtatattacccttggatagattgcgggattttacttgcatttcattgaagatcatctcacatgtgttcttctctacctgtgggagacagccacgccctctccaacaaggcctaaacctcactctatccacagaacatagccacgccctctccaacaaggcctaaacctcactgtacccacgggacacagccacgccctctccaacaaggcctcaacctcactgtacccacgggacacagccacgccctctccaacaaggcctaaacctcactctacccaagggacaccgcctctctccaacaaggcctcaacctcactctacccaagggacacaaccacaccctctctaacaaggcctaaacctcactccaccggtgggacacagccacagcctctccaacaaggcctcaacctcactgtacccacgggacacagccacgccctctccaacaaggcctcaacctcactgtacccacaggacacagccacgccctctccaacaaggcttaaacctcactccacccgtgggacacagccacagcctctttaacaaggcctcgacctcactgtacccacgggacacagccacaccctctcgaacaaggcctcaacctcagccctacctggggcctcctccaggtgctgggattacaggcatgagccactgtgcccagcccttgatttcttaatatactaaatttttaatttccagggtttaaaaagaatagcttctagttttcttccaaaattgttcactttgtcctttaattccttatacatattaagtaagatgattgtcaagtctgtgcctggcggctccattatccaaatcctctatctctgtcttgtcagctgcttttcttggtttcaaacatatatacagttttccagtaattacctgtttttttttttaattgaatgctacaaattgaaaacggaaattgtacaggtatttggggtgatttgaggctgtgaagtctgaattgttttgagtttctttttcctcctacgcgccttttagagtctcagctcaacaactgaggagtttccccagatctgcttctccttggcagtgcatcacctcctgctgttgttccccagccccatgagcctgccgtgatctactcagcgtccctgctgctgggtcccttttttggagttgccagatgcttccaagagaggtggccccaaacgaaagctcaacccctggcttcccctcctcgagtcttggccccataatttctcatagcctggctgcctttccttgcttctaaaatattcccgaacatacacacagcctttctagctgttctccaggtgagaatggtctgaatcacctcatctgccgttacccgcaagggagcccgtgctgttctcaaaaccctaaacctgtgggaaccacacgcccccagatttgtgcacgtgatttggaatctggtgggctcagctttttagataatgcccagtggctgcacgtgagggtccgcaggcacagagttggacccacgtccccagccttccatgtccagctgggactctatgtggctctcttgttcccgttcctgtccctctgccctccagactatagcactgcagcccagctgacagagaggccgctcctctacctttaagttgcaaactattcagaccaatatcgtgtattataatttgtaaaccatgggttttatgcacgctaaaatggactttaattatgatcactcaaagtctgtaaatggctataatattgggcactgtgtagtgagaacatcaggtaatgttacagagcgctgaattgtacatcattttaaataaagagaggctggacgagaatatcacaggaatgcacgtttccttggttcagagcaatattagcttaagaaaaagtattttcactggtttcacgaaaagttatcacctggtgcattatttcctgatcttcacttcgaattgttttctttccccaaagagttgtatttttacaatgaccgacatgtgtgtgtgctttatgtgtaaggtttcaatgcagcgttcattgagaagctggatgaactcatcacgcttttgcacctgctcagattgctttcagtaactctcctgttactccagcccccactgtggagaaccactggtctgagatagacatatatagcttccctcttactagcaacctagccattatgcactgacctggattttcaaaagaattatttcaaaaaagaaattgctcagttcacctcccctgaccttggcatggaacctttgtaagtaattaattatttgcagtaagtaagtgaaccagcccaagcttctctacaccgtcattttcatagtagtcatttaaatttaagtgcgtgtccttctttaactgaatttaatctgagatgatataaatttttaaaatcatacagttttgactcggtacggtggcttatgcctgtaatcccagcagtttgggaggccgaggcaggtggatcacccgagctcaggagtgtgagaccagcctgggcaacatggtaaaaccccatctctaccaaaaatacaaaaaattagctacgtgtggtggcatgtgcctgtggtcccagctacttgggaggctgaggctgaggtgggaggatcgcttgaggctgggaggtggaagttgcagtgagctgagatcaagcctgtgcacttcaacctgtgtgacagggagacctcatctcaaaaaaatttttttttcataagacagttttgaaatatcttcccttttcaggaaacttgctgtagcctccttcttatttaaaaaaaggggggaaaagttttgttttcctttaatacgtaaattgtatgttttccgtgtagattattaagcacataagcaaaaagaattaaaatcatccattttctccagcatgccgggataaccattattaacactttgtgtatacccttccagacttttgtctaagtgtattcttgggtatttttttgattttgtgcccaaagagataatctaggggaatggccaccagagcgtttcacgagcttcttagatgatggaatttgggatgatttgtattatcttgttttcttttttatcatcatttgagtacttttagtgagtttgtcctatttcttggaaaccgtagtttttcatttaacattttgtttacatacagtttgacaatcattcagtggggattcacccattggctcatcgtatgtatgcggcacctgttctgtattcaacgtttcatgccatcaaatatgtacacggcatctgttctgtattcgactttcacgctaagcatcgtaacagcaagatgaagaaagaatgtagtcctcactttcagagcgctccaagcctcagcttagacacagcctaggcaacagtgtctcagagacattcacagctctctgggcaggcatcaaaggagcagccccaagcagggaacccctgggttggtgtgggagagaccccaggggagtgtcctgagaggaggccggacttgagccaaatgataaaggatccataggtgtcccctaagccaagaagacaggagggtggtctgagcagagcacacaggatgtttgagaatgacaagtctgacatggctggaaagcgatgtatttggtgaaatagaaagatggggaggaacagaaaatagcaccaggaaggtaaacatgcttgagttactcagcctccaccatggcagccgcgtgactgtgctggggagcagacactaggcagttaggggtgcacaaggtttgttggatgtaacacctggcagaggccaggacagaagctggacctgatgtacacctggcccaggctctgctggccccatagagagagagctgtcgctccaactcagaggtggcccagcctctgcaggccccgtggagagagagctgccactccaactcggaggtggccagactctgtagctcagctgtgctacagggccacccagaacagagaaaggcctcatctgaacactggcccagtccctgtgcgtaccagctgggactgtccctgtaccgcgctttttcctgccaagggcccagccccgtgtccacaggcagcagacagccatcggcatcagtgggagcagctgttttttaagtggggaagtgacatggcccaggcctgtggactgtggagatcacaccatgtgcttaacgagctgccgggagctgtgagattgatttatgtcaaggaaaacaagtcattatccatgggaatttatctagctacacagaaaattaacagtggaacaatggcgggtaataaaagaaaaagaaagtaagggattcgttgagcaccaaagaaatttagaggaagatctcagctgtcatcctgtgctggacagtccgtcacgtgcagagcatcctcccgactggcgaggtggcttccacgtgccccgtcaatcagggctggacagtccgtcacgtgcagagcatcctcccgactggcgaggtggcttccacgtgccccgtcaatcagggctggacagtccatcacgtgcagagcatcctcccgactggcgaggtggcttccacggagcgattctcgagacccgaggggcgtggacacagcttctacgcaggcagtcggagagccactgggctcttggccctcactcctccagccagaggagttttgctttcctttgtcctgcataagattttgtttgagtagctaaaaagtaatggaaaaccaccacaatgatcagtggagaaccttgtatgtttgggggcccagctgtgtgttaagagccatcagcctgtgtagcgtgagccagggcagaagggcctggcccgagaatgctgtctggacgcctggcaggcctggctgcagggtgccgcagaggaggtgggaagaggcatctttgggaggcctggctggccccagtgcaggaccagagagcagctgagggcctggggcctccggggtttcgagcctcagtgaaacgcgaatccacagggactcttggagtggggaccagcagtggagaagatggaggcattgcacttgattttacacacgttccgcttgagctgtgatgccaggcaagccgagggtgaagggaagcgccttgtcgtgagacctggaaggagcagggctgccgctggagcagatcctggggtgtgaaaagagctggcgacgcagtgctcccagaggtcactaagggaggagccgggtgccaggggagagacagtcaggatttgcagattcagcaaatgaagaaaggcaaggctggccagccactggagtgagggggcttgggaggaggtggcttggaagggcggtgaggacagaaaccagctttcgcatggcaggtaagaggagcctacgggggccaaggagagcttagctagtgccagcttcagggccacatgggttttccccagggtagacaggcataaggccccagcggccactgcatgttgagccccagcagccagtggtctccccggcccatccctggtcctcccattcctgcgaggcggctgcggggtctgggtctggtttctgccacttgtctctagtggaagacacaccctcatagagcctcagtttctccatctgaaaagcaagtgaacataagacctgcctggcgtgggcattgggaaggaagtcttggtggacttggcaggtgggtgacttgggggcctgggtccaccgagccgcacagcgggaggcacggcatgagtgcccagctggcagcggtggtggaggtagtgtaaatgttcatgctgaagaaaatccaagcctctgagaggctgggcagctagtccacagtcacagagccagtctctggccaaattcaagcccccgtctgtctggctcccaagtttaggcctggaagtgaaggaaaaggaaggctgggggttctgcaggggagacatcctgatgacctcacagccccttgtccttgtcctctgcatggatggggccagggacggcagtgaggcggccaccccatggggaggagatcatgtgttgcgtctcctgagtgcagacggagctgaaggcgcccccgagaatccaggtgagagcaggaacctggagagactgggaggcaagcacctgccacgtgggcacctgtgagtgaaccggggagggacagggccccaaggagtgggtggcacctcatgctggaagtggggagcaggcagagtgatggggcaaatgacagggagccgggcaggtccgggagaaggggtgggggagggagcacccttgggagagtgactgtgatgggctgtgatccctcaggcatctggtggagaatcaaaggcgagggctggagacacagcagctcttgttgagtgacaagttcccagcagagggtggtggtggggacagccaggggtgtcagggaagaagaaggggccttaggggaagggcacctgcttggcatttcggagctggcctggcactctacagtggttgcacaaatggggtgtggatgctgaagttctgccagagtctagcagggccggggtcatcatgatgacctggatgttgcagtaaggaagataaatcctggcaagaaaccgcatgccacaggtgagcccggaagtgtgggggaaggtggagataaaccctcctgccaatggcagtgaaggagagtttgaggaggcgcgggccctgttggggggccaccccggcatctgccacatctgttgttggagtgtcatctgttttattttagtcgccattttgcatcagggtcagctgtgttgactcagcagagaaacaggtaccacgagtcatccagccatagcacggctgggaccagcgcttgagttttcttgtctcccaattcaggagtcttttcctgaactgtagctttttacagttttcacatagaagtccttgattaacactctgaatttaaattttaaaagagccaccttgatcattaaccctttgagggttcagagaaacttctagaatgaaacatggtctgacatggacaacatacaccaataggcttcttctgtggtcccctcgtgatctcagtggcctcccgagttgggcaagactcagcattggttaggatcaggtacagaaaggaaatcagaaacaaatcgtttctgcaaggatttaattttatgtgacgtgaaaagtgagggatgctggactcggttccaccttgtcacccccagtaggaccaggcctgctggatcaagaagcctcatcagcttttgctcactggatggttggttcatcgacttgaatgatttctgggtctgtctgaagtcggctgggcagatgactctgtctggtttcacgatgagcttagggaagagaccagtgggattttcaggaccatgttgggagagtctagctttgcatttatttactggtgatcatcacaagataccaatttgtaaaaacacaactaagtacacactggtcctatctggcctccgtttatcttgatggcttggccatccagtgacagtgctggggtgtgggacctcgtgggaagctctttgctgctcagaatgcagctttctgttaaccagtggtcacagactcgggaacagcaggggctctatgagcttcagtcgattcaggatacgtgggctcacgttagggatgtgtttagtcctggtttgcaaacagcctgcgggcaaatggtctgtctgtgcttgtgatggtccctgcacttcttccggaatgcagccctggcccccgccagctgctcgagctgtgctgcacccctaggctccctccccagcatcaccagggccaaggatgaggagatgcaggagccagggttttggcagttccctgttactcaggtgggcacactcattgcagtaaatgttgatgtataaagacaaggaagggtatccccatgatcgcattttgaggtttttcctccaattgtttctccttgcacatgtttgatgtaatcgtgactatagagtatttgtcttgcttctttacttaatgttataaagcattgtcccatattattgaaatattcagaacagtttaactgcttgtagctgctgcgtcgtggttgttgcgtggtttgtttaatcatttccctctcattggtttcggagcgaattttgggctttctgcaatggcagatgacacagcaccacacaccctacatcccatttccccatcttgcttccggtttaggtatggttggttcctggaagttgatgtactgagctatgtagatttttccgacttttacatgtggtaaagaaggtagtgccagcgcacgctcgtacaggatagaagtgtttttgtttagggcagggacagacacatccagctgccttagaatgggggctctgcacaccagaaagaccagctgtgtaacgtagagtgtggactttgagtgatgcagtatcagtcactcaatcggtcttgtctgtgtgactctgaatacacagactccgggcacttcccaggctggcagtgctccaggcacgttgttacagtcgtgctgggagggtaacatgtctgaaccccatggagcgaggacctgagctctgcagttggtgttgggccccaccctgccctgggcgcctctcttcctgaggcttggggacggtcctctgccctcatagtttgactaactccagatatgttgagagaggagagaacccgtgacaggatgctgaagatcagcaactcccgtgtcctccttccttgcacagtcgggccacttatgtgtttactgatcctaggccacagagcttcggcgtgtggtctgggcgctgtctgtcctctgcatggctttggtaaggagggcaggcagcgctcggtgacagtcctgcagcttgaaagaggcggtgtttttgcggaacagttattgacgatcttgtcagtcatttcattaaaacggttttcagcatatgtgtttctcatctgcaggtgtgggacccaagacacaagtgtgttggggctccatgtccaccccacgatgccccccgtgccccttctccgtgctgtttcctagggctgtgtcccgggcagccacccctgttcgcgctggcgcttgagggctgagatgagcaacctggtaaaatgagttcctggattgtttgcttgcatttcataaggaaatgtcttctctttgggaggtgtgccccaccctcacattcctccgtggggccaagctctgtcgtaggttgttagagggtgggcacctttgcttttcctcactcccctgctcggaggtcggagggcaggcagcctggccattcctcctgcgcacagtggacatgcttgttctgaagcgagagcagactggggagaaggaggaggggctgagacgagtctctgctgtccttgtgccgtgtgttcgcctccaggcctgggtttcttttaaatggtgggaatccttcatgatgcctgccctccaccacccacacagctaatgaaaggggcttctccgtcatccccgtcctggccagcagcctgactagaaaaccctgatgttgggtaaactggtctccactgtggaggtcgaaatttttcttgaatttggaaatctttgtttgagacttccggcattgtttgagcagcagtgctgctttagaatattatactaacttctcaatttctcctttttcttgccctatcactgaacctattttgaggaaataagacgttattttctgttcgtaaaggaaagaaagagcatgtgttgaagaattacattaagaagcttgcttaggctgggcatgatggctcatgcctgtaatcccaacactttgggagggtgaggcgggaggatcccttgagcctaggagttcaagagcggcctgggcaacacagtgggactccactacaacagtttaagaaaagaagttcactgaacttagctaccctgtgttactgatgcatagcctctttgaatattattctgatgaagacggtgccatcagatggttcctgcagtgggaattgctgatcagctaaatctttttgacagcgggatcatgcttatggctctgaacacgtggcatttggttttccattccgagttacttcacttagaataatggcctccagctccatccaagttgctgcaaaagtcatggttctgtcctcacggctgaggagtggtccttggtgctgcctgccccatgcgaaatggcagcagcctcatccccccgcccactctctgtcgtatttgtctctgcgtcatctgccgtcacttgccacctctaatgtgtgcttgttcatttgcctgttacctgtccttccccctagacccttaggacagggcctgggcgcgcgctggcaatccccacatccctgtcgcaggtatcagctgcgtgttgaatacacgggagcaaagtagaccttgcgggcgagactcctcccagcatggacggtgtacttccacagcgttcggtggctgaggtataaccctgcagagcatgatgtggactgctttcagcacgtgccacagactgcccttggggtccagtcatcggtccatgggaaccatgtgtgtgaccagctgggcttggtctgtaagtctggggacaccagaggaagaagctgttttggagatgtgcgggaaggaggaaagctgcagatggaggttgagctctgagctgtgagctcatggagagtttgattctccctgccgtgcgccaagcttctgctcagagccttcctccctcgctcagagcctttcgccgcccgcgcccttttttcttgcaacctctcttccattccctgctctcagagctgtggcatcactcatgagaacgccccttgttttctaggatccctggccgcctgaacgacaggaggacgcccctgggtgaactgaactggatcttcacagccatcacagacaccatcgcgtggaacgtgctcccccggggtgaggcgcgggccgggccttggggagggaggctatggccttgagtgcgcggggagccgactctcggacatgagaggagtcagataggatccgtgagtgcctccctagtgaggaagacagtgggaggggctgaaaagtagaaggcgaccacctaaggaggtgtctgcgagggggtgagttactgcacgccaggttctcagaacggtggtgtggagagactgcgtgtcagcgctggccctgaccggtgcacagcccttactgcgcaccggcggcttatcttcagagtcgtcggcattattcacactggctggaaaccagaattgctgttgtaagacttgtttgtattttttattgattggttgatttggggtgtttgttcacatgtacgtatatgtgcactgtgtgtgtacatgtgtacatgtgtatgcatacacgtgtgtatatgcatatttgtgtgtgtgtatttgtgtatgtgtacacctgtatgtgtgtgcgtgtatttgtgtatgcgtgcccatgtgtaatgtatctgtataggtacacacctgtgcacacacatgtatgtatgcatgtgtgcatgtgtgtacatttgtgcacgtgtgtgtatgtttaagtgtgtgtacgtgtgtgtttaagcgtgtgtgtgtgttgctgatgggagatatgcatattagtcccaactttagtaatttttgatagaagtgaatttgtgtatttggctttaaatgctagacacaagtcactgtagactcctttttatcttttatctgccctcagatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggtgagtgtttcaggatcctccaggtgccgtgctcccccgccctccgtggcactgtgatgtcatggaattgcacggagctgggcagggaggccccacacctaacttggggaccccgtgtagcattaacaagtgaagctaaatgcagggctcccagagatctccacacagaggagtgggggtctccttcagagggcagaagccttggagggccttttaggactgcacgggagcagcggccggctgaagcctcacagctctgcaactcgggagggtagcactttgcaagagagtttctaaccttttagaaaccagtagtgagaaaataacttgctgacttgaatttatgaagcacatgcaagatcgctctggagaattaaactgttgggctcatgatcaattagtttttatgcttatttctcacacacacacacacacacacacacacacacacacacaacgctcataagtgtaatcctttatgactattgattatagttctctcccattgctgagttgctactatttatacaactcctattagtagtaacagtgacaataatgtgatttgtttttagtctagacattatatttgaagacgtttggtttctttctgttctgtggctgtcctaacaagcaggtttgggcaaattctaaaatggtattaaaacaaaggaaaaatatttctgttcatcaatgggagaaaccctaacaacacaaatatttttaaaagagcgattaacgtatgcctagccgcagaagccatcatgtggcgtattttcatggccaggtttattttagctagtgttttgtgttttctttttaaacgtgtacaggaccactttccctcaaccctggaaacccagagaagcaagaaggaatctaaactcactacccatcacccactccagaaaagttagaaataatctaatttttaatgtttataataaatatttatatgcgatagatcaaaatacattatacccagcatagcacttggactttaaacagcaaaagttaaagcatgcatgatctgtatccttcttaagactctgtaagataaaatagagaaccctgataaggagaaaaggaaattgaagtaaaccatttaaataatgtgtaaataaaaccaccgcacatttatttttcacgaatccatgaataacagagctgtaaaagagacaggtgtttgaaaagcctttgcaatacttagaataaatatttaaaatgaacattttttaaaaataaatacttagagcatttttgaaagagtatattctcaaaatggccttattcctttaagaaaagtaaggccttaaatcctgtctctatttcctctaagacaggttattgtaatacatttattttaaaagaggaaggaaaaagaaaaaaaaagctgaaggggtcagtgccacatcagatcctggatcaaaaactagttcagcactgggagccggttgagcactcggagcggggtgggcagggcctccagacttgcaggttcccttaccaggaatcagtccatggaaacctttttccttctagcgtatgttttctccagatgtaaaagcacctcctatctgatgtgctcagctgcgcagagttaaagacagtgacatcacattggagtccgtggtcaaagaccagagccagagcacagagaggagccaggagggatgagcaggcgaggacaggtgcagggaggggcatgtggcaaggccggcgtggggcagccacatcccacctctccatctagaggccgcgtggcgaggccagcgtggggcagccacatcccacctctccatctagaggccgcgtggcgaggccagtatggggcagccacatcccacctctccatctagaggccacgtggcgaggtcagcgtggggcagccacatcccacctctctctctagaggccacgtggcgaggccagtatggggcagccacatcccacctctccatctagaggccgcgtggcgaggccagcgtggggcagccacatcccacctctccatctagaggccgcgtggcgaggccagcgtggggcagccacatcccacctctccctccagaggccgcgtggcgagttcggcacagggcagccacatcccacctctccatctagaggccgcgtggcgaggttggcacagggcagccacatcccacatctctgtctagagactgctttctaggactggcccctcagaagttttctgagtgccagcatttatatcagtgctgctttatagaaggtccttgtctaggcctagctgcagcctctcccagcgttgctggggctgcccttccctgcccagaaaaaaggccagctattctgcagactctgctccctggagcctcacagagccagccctcacctgtgcttatcggttgcactagagaatcatgaggtgatgtcgcaatccacagaggcccagagagcctggggacagcatcacaagggtgcctcgcagcccctcttcctgacggtcactgtggacactccggcttttctcctctcctggttctgacctccctgagtgtgtcagaggctccgcttgggctaatgtgcgcctttagtgatccagcccgcatggtccatcatcccaccacaagcagcctgcggtgtcgtgtcctcccgcttccctttcgggcgcgttcttctcctggttgttgcagggtgggctgtctgggaagtagacggagacggaggctggtgtcatgacactgctcgtgagtggagcagccctgggtcagcggtggaggggtgggcggagagaagtcaggctcacctccgccggccctggggagctctgaggatgggatgggaggtgagtgggcctgcctgcattctgcgttggttgtcagacataggccacccagaagagggcctgacagccgtgagccacctgcctgtggtgcccccagcagctggggcaagaaaaccttgatcctgaaggggatcccggcccctccctcacagtgtcttgctgtaagagaaaatctcacctgccttacctggggctgctgttaccccagccccattttgatggggcccttgggagcggaggaagcgcagtgcagaggagctcttccacaagcgcacagcccatttgcaagaaacatgtttcctctcctcatccgggaaagtgacacttcccggccggctgtgcagagctcgtcaccaggccctgctgaggcctgtggcagtaaccgcaggtctggactagaagagagcagccagcggcacccggccactgtagcggtcactggtgcagccactgccagcagccagggcctccggcccagcccaggtacagcggagtgaactgtgttcatgtagaatcacagcggcgatgcccttaattgctaggctggggcagggaagcaccgccctggcctcctcctggtccctggcacccttctgccgggtgtcactgtgtccccatggttgggtttgacggacatcagggatgaagactgaagaagaaccaggccaggagtggtgaagggcagggctcctccagtggggtgcacagggtgggcccccgtgccgtcaccgctggccactgggcacacctgtgggctccaccagccacacagctagaactcgccctgctgttgccgatggcctgggtggctttggggtttcaccttcaaccggcagaagaaacattatgcgcttgaatttttttcctttttcttttttaaactcacacctgggcacgcatctgcgtactgccctggcgactgacgtgagcatgaagggagctttagtcagccgctcggcccgcgggaaggaagaggcgagcaggagtgactcacaccaggctcgggctccaggcttcctggcaaagcagtgaatgtgaacacccagggggcagctgtgccaaattgaagctgatttgtgctgaaagaagaaaacctcattcacagattacagaccagtcatggcccttctggtggacgcgtctccctctgcttagtaataggagttcctccagcgccacttgtgggaaatagaatttgaaggtggaaacagcactagggagggcactagccatctaatcctgtgtgacagcagtgtcgctgcagacttggcagctcagaacagcacgtggcctccagatccagttcctgttgtggggctcagccaggttctctgtgcagggtcccatcaggttaaggctgccttcgcagttgagaccacccgccgtccccaccagtggggtccttagcttggcctcccaccactcagagccagcgcaggagccgggtgctgcatcctcacctagtgccacacacagtcacagcagccatcaccgttgccatattctgctggttgaaagcagtctcaggtcccacctgcacccccagggaggggccacacctgggacaggggtcctggggccacgttcaagcctgtccacctcagctggtgaactgtgctggggtttggagagggtgagagtaaagtcgcagagcccagggagcaatctgaccacagctcccctgaggcacaccagtcgcggcgggtgaccacaggtggtcatgtaagaataggaattccagtgactgactgattaagcgcctgctgcgtgttgggctttacaattgttaggccatctccccctcacagcaggtactgccgcaaagctacgatttttactatcaatatgcccattttactgatgagaaactggggtgtgtgaggacctgcatggtagggccaggctgtggctctagccgtctagtgccagcctgccccatgctgacttagcggcgtacgtgctgagtcatgggatgtacgtgcatgagcttctgtttcaggcgcatccctgggacaggagtgcacccaggcagaagtggtgtttaaccagggaggaaagctcttgtcacctcttgttacacatggccactgtgctggcggatcacagcatcgttgtcagcgtgaggaagcttccccggtgtctgaacgagtctgatcaggcagagacgagcagggagtggcacttagcgacctgctgtagtcatgctcctgggagcatgctcctgagaccatgcgaggtctcaggaaggatgtgcgcctcatatgagaaacccgtggcaggtggcattccttgcattttgcagtcagctgcatcccacctacagaacagagccctggggttttccctccagctggacatgagaagctgctggggagtcagcagccctgtcctgggatccgagtcgtcttggtgactcccacgcttcgatgcctggccgagacccgcctggcttgggcctgcccttggttgggacctcactgacctgaggcccctaaccccgacccctgccttggctttacggcctttacagtgctggccccggtggccacccacctgcctgcccaccgtgctcaccctgcctttgaatgcccagcctctttgccccacaaccaatgtgacctggcttaggagcatagctgaagcaggtcgctaaggaaaaaccaagcaacgggactaatgggatgttctgaaagacaaggacaaatcaagccatttgtcagaacattggttataagagggaaaatttgggaataactctactacctaacagaataggaacgtaaattcagaacggatacttaaaagaaaatgtaagcagtcttaaaattttattcatgagtatgcaaaatatatgttaaatgagagaaacagaacaccaaattgcatcagcaatatagttaatatctatgttaaaatacatagtacacacagcaataaaacactaaacagatttataaataaacattaatgatgcttgtgccagggtggtacaattggagtgatggttctccattttaaaaattgatagatattactttggttaattaaaagtctgcctgtagattttctaagccttcgaagcactaaaagcaatttttaaaaatagagtctttatggctaaggcattattgttcataaattcagaactagagacacacagaagaaatcattacatacttctttacatgaggagaatcatgactggtagagtggcctaagaggcaggcgtgggggctttcagacagcagaaagacggggctggtgtccaggagggcgcgggcatgggtagggcagcgcccgggctgtgctcagtccaaccggggctctgcggggcggttttggcccacagttgccagtcatagagtagccaaaagttcatattttcatttttaattatctgattattagatgttgatatctaacgtggcattaaaaaacattctgcgagcccaaccagacacatccaacccgacacatccaaccagacagcggcctgtagcctgcctgttccaagctgggccatgaacccctagggacagaggcttcagtgaagccctcggtgcctcggctcccagcatggggggcggcccgtagacatggcagtgccgcgtgcatggagagggcggcgtccacggcgacttgtggccgagtctcaggatgcttcccccactcttcttcctcagcccctcctgtgcgtgtccaagggtcctctctagttagggatattttctgcaaggtctgacatcgtgtcttcttgtctttctatgctgggaagtgccaaataagtaatattaaagggttctttgtacagaaatcaatgatgatgtgaattcagggagaatcacttgcattttacacatgttctctggggtaggttttcagcaacaaggatgccagcgtgaatctagagctaaaaagtaaacacgagtcagttccatttaatgctgaaaattatatcatgagccaactttgatagggaattgaatgtaaaaattgggctttagatttggagaagatcctagatcctcgtaggagaagaaagactggaaatgtggtctggctggtcaggagccgggacagcaggtcccacgctataggtgtacacagattctccccgctggcttctctgttctgtggcatcttcctggtttcctggagtcagggcagctccactggcctcagtttccagagaacaaacctgactgaggtggacttgccaccttggccactgaccagttccgaccccgccccgccccaactccagctccacccagttctctcatttcctctcctctcactgccaccaaaacattatgtcaaaaaatgggggtttctcagtctgtatcagttcactatgtgtgcagaaaatttatcggaatgactttaacggtagtagaccaccccccaattctgagtgctgacagtttgtaaaaggccctttccaggtgctctgccaaagccactcacgcacggccttctcacggcgtcgggctgctgcgccccacggtgcccccgcgctgggccatcttgcacgggccgctgctgtccagtggcttcgaaaggagtttggtagttgaggtgagaccgcaggtgcgctgctccagtggcttcgaaaggagtttggtagttgaggtgagatcgcaggtgcactgctcctcaggaatggcagaggcttcccatgatggggagcatcattttcatcttttttttttttttcggaggcggggtctcgctctgtcacccaggctggagtgcagtggtgtgatcttggctcactgcagcctcaacctcccagggtcaagcaatcctctcacgtcagacccccaagtagctgggactacaggcacacgcccagctaattgttttgtattttttgtagagatgaggtttcaccaggttgctcaggctggtcttgaactcctgagctcagacaatcctcccaccttggcctcccaaagtgctggaattaacaggtgtgtgccaccgcgcccaatagggaacatcattttaaagcagctctttgcttcccagcggagattccatagcagccgtgtgttgttccgatgtgtgttttcccaaatgcgctacacaattaaggtgcttaggagggaggagaggcaagcacagaggtttggcttgcactagctccacgtccttcccgggtttcagaaaggcatgtacttgcccttgcactgcccagagaccaggccccagcactgcctcctctccattccccacggaggctgagacgattcctcagtccatgtcaccctgagaaaatccccctccaataaggcatttgattctgtggagtccgttattgcagaattttacctccactctgtcctaggcgtgttaacattcgaagtctaattctaactcttagacactctcaccacgtccttaacacgagtgagtttactagtctggacacaggagggaggcttctggaagactgggaaaccccaggccttcttagatatgagcagtccttgctgctcgtgatgaatttcatgcatgactttatcactgtccatcggaatcccgccgaggctctggaggcagagatgtcagatctctgatgacagtgaacttccacagagggcagcagcatctccctgtgtatccttgtgtatcactatgtatccctgtgtgtcactgtgtatccctgtgtgtcactgtgtcactgtgtatccctgtgtatcactatgtatccctgtgtgtcactgtgtatccctgtgtgtcaccgtgtatccctgtgtgtcaccatgtatccctgtgtgtcactgtgtatccctgtgtgtgcctgtatgtcaccgtgtatccctgtgtatcactgtgcacacagtaaaatttaacaagaagccagtccattccaccatgttaccatgttgcagatttagggaggcgtaaccacacagacttggtactggtcttgattgtggagggcctttatgctgagccagagatgaggaagatgttggtgcctggctataagggcttgagccaggtggatacggagggcatgcagccaacaccgctcttgagacaccggctgggttagtgtggaaaaactccattgaatggtttgcctttctccctggaggtagttaggtgtactagttgaaacacccattcattgggaacccgtgatccaggggctttacaaatgggcatgtgtgagcataggcagcataggctgccgtggccccaggtgtcagggtgcaggcggctcctgtcttggaggcttccatcccccgtggaagctcgtgctggccactggagcaacattcccgcaggtgggaaggccgcgaggagtggacgaggcagctcaggcctgggggacagacttggagctcacatgcccatcgcccccctgtcctgtggcagtgtctggtccagcctcatccagggagggagggaatgtggcctccaccttgagtggcatgtcccagctccaatgctgttccttaacaagggcagggagggaggcacaaaggagtgaggagtggtttcagacgctcagacggagaacattcggctcagaaacagaatcgtgctctcctctgttactagattttgccaactgcaactgaggactgagctgctgtggaggtgggctcctcaccatgggagcatcaccgggggctctgcagggctgtctgccacgaaaacaatgcccagagctctctcctcccctcatcaatagaccaaagtgtgtacatccccagggagcacacaggaaagatagcagaaaagagcatttggaataaataatgtacaatctagctattatactccttgggtggtgatggagaggttgaatttttagcaagaggaaagagggaacaaagcctaacaaacattgaggttaaaacatgaagtcatctgcatttacactttgcttcaggccgcggcagtaatgaatactcagagccggctttctgtttaatgtttgatgcaaagtcaccggggagtcattctccttcactttcaatttcaggggtcctgaaaccctgcgtttctctgcggtaataacccgtgctttccgttcccggggcgggcgcgctctgactgatcagcgcagatggaggctgtgcggacttggacttggacggttttcctccagcccacctcctgggcacccgccatctcagggctgtttcctgaaaacccagctcttgcctggatgacatgttttccaggcgagtgactcatcagaacagccaacagcttagaaagtccctctgcccccagctgctgggggggaggagcccacgatgcagatgagctggtcacagctaatcacagcctcctcccctcagatctgcactccagcactccagccctgcttctccaggcagcttgatcgcaggctgtgggaagtgctaatccagacaccttcccggtcccctcccaccttctgctgtcgtgtgctgccaaacctcacagggctggctgctgccgccgaagcccaccaccatggcctctcgtgtgtacgtaggacccactttcccacttgtctttagctgggaatcccaaattagagctgcaagtgtgtgttgattttaccgtagaaaatgcagccagttttaatcaacagataaatgttcattagagaataccgttgttctgctgtttaaaaggttgccgtgcaggccgggtgcaatggctcacgcctgtaatcccagcactttgggaggccacggcaggcagatcacctgaggtcaggagttcgagacccgcctgaccaacatggtgaaaccccgtctctactaaaaatacaaaaattagccaggcgtgtggcacattcctgtaatcccagctactcaggagaccgaggcaggagaatcacttgaacccgggaggcggaggttgcagtgagccaagatcgcaccactgcgctccagcataggtgacagagtgagactccgtctcaaaaaacaaaacaaaacaaaaggttgccatgcgattttagaatttaatgggtaatctggccctgtaatttggttaaataaataaataaataaaccacccacggccccgagagggcctctggcttgctcagcaggcggtgccagggtgcaagctcctcccagtacctccgtcttccctgccttgctctgagtggggctgtccttcgggcccaggccgagctgtggcttgaggttcagggccgcttcactgtgtgctgataatcgggttccagcgcttgtctttcagcggtttgtaggcgttcttttacatcctttcttctcattagtacttgaacaaagttattttcctcctctcatgtagacagctctgcctcgagtccacagccctgggtagccggacggccccgagcagcctccgtgcatcgtctgggcgccgagccacagcccttcctcctgggctttgtgtcatccccgcagcctcctgagcctctgtgcatcagtgaaaccagaaccatctggggctgcttttctggtctgaaatgtggagctgggtcagtccccgcctcccaccccggggctggatccaagtgggcccccagccttttaggagcacatgtcccactgcagcaacatgggtcacgtgtccgagagagattgtcacccgtggctctgacacagctttgctgggcggcatcctgtccggtgtgctgagcgatgtctccagtgcagttcaggccttcaacaccaagcgagggccttggagaacgtgcgaataggctttccgggaggcatggttccaaaggcgccttgcccagcactgaccgaggccacaccaggtgccacgctggtctgctcggcccacggcccggacaccctctctgccctcctctcgcctccacctcccctaacttgcacacactttcttctaactcctgaagcagaaactttttatttgattaaattcgaggaatctttatagagtttaattgcaataattgactttgcttctgtcttaacaaagagtaaaatctccctcaatgctgctgaataccatttgcctgcagctggggatttactgggcatatgggagctatttattgcacgtactttgaggccttttgattatctcctgattgcttcttaactctgttggcaggggaagggcatgtttgtgcaaagagggccagtcttgggaaaattgaaatatatttcatatatttgaaagtgaaaaattgctctttagtccctttgttcatcttaaacttttacttttttttctggattttaacatttttcattctcattttggtcctttactaagacattgagaaaatatgccctttgacacggcagcacggagtgtcattaacctaaaaaataacacagagtcctcgagtctcttagaaaattacccaggagaagagagcgcagtgctagaagcagaatccagtatactgatcatcactcggtttccacaaggaacatatttctagcagaaagggagagtagggctgaagggattgctgtccttcctccatccctacgacgaaggttgagtgtccctaattcaaaaatccaaaatgttccaaaatccgaaactctgtgagggccaccacgctgccacaggtggacagttcccctcccgaccttgcgggcgcaaactttgtttcatgcacaaaattgtgtaaaattcgcttcaggctgtgtgtgtaagaggtatatgaaacatacatggagtttactcttagacttgggtcccatcccctgatatctcattatgtatatgcaaatattccaaaacctgaaaatatcggaaacccaaaacacttccggtcccaggcattttagagaagagatactcaacctgtatccgcggagatcaagactgtgttctgtggctgtgctgagagcgaggtgatgattcacttccagttgagagttcatgttggatgttgtggcggggccacagcagctgcctccgactgacccctgctttgtgtcagccgctctacgaggacgctgtgagggaggcatgatcataagcccatttcacagatggtgaaacggatcctagagagagagccacgcgcccagagccccagagccacacgctgaatttcaccaagcagcctcccacacgggctccctggtcaggccctcatcctccgggcgaggcagcgaggcaggcaggtcagccgctccctgggccggagctagtgggtagcagagctgggagcagagcccaggctcatggctcccggtcagatcttttcttccctctctccttctcgaaagtcacacggggctgctcatgcacagagggtgctttcctgctcgccctcactctcatttagccaatgcatattgaaagcctgctatgtgcctggcactgggaaagaagttgggtacggctggatgccagggcacctgcaggatgtctgtaattcagcgtgtggctctgcggccttgggcgcgtggctgtctctctagggtgaaacagtctcatgatcatgtctccctcacagtgtccttgtagagcagctgacacaaagcaggggtcggtcagaggcagctgctgtccctctgccacagggctagagatgtcagaggtgctggggtgtgccaggcctggggtaccacgagaaggccagagccacagaaaggcttaggggggctgtgttagagcctccgagaaagctcacagggcagctggcctggagggaggtgccggcagaggggcccattgggagggggctgttaggacaacaccgaggctctgacaaggccatgtcaggaaagtggcgatggtggctgggggtgccccataaggctgttgcctacacctgggaatcccaggaactggcctggaggtgtgaggtccaattcagactgccggctgttcctacagtagaattggggtgtggagctctggggagaggtgtgaggctattttaaatagcgtctgggggtgtcggtgagcaggtggcattgggcgccctgagcaaggatgagagcaggcagggaaagggctgtggaagctgcagcagtgcggccctgaaggacggggtcgggagcccggggaggaggctgtctcacgttcaccgtgacgggaaggaggccggaggagaaagcctcataatgtccaagggggagaactcaagagggacagtgtggtcggttactgtgacaaggggtctcgacaggggaagcacatcaccggggtcatctgtggagccactgtggcttggggggagcagctctatgcatggtaggagaccccagactgcagggtgcctggtgagacccacagggaggcagcaggaactgactgagcaggtggctgtccacaccagggagcagcaggggggaggcaagggagggacagggaggggcctgacggcaccatcacagcgcagagctcagccctgaccgccaggactcctttccctgactgcatgccgacccctcctgatgaggcactttgggcctggccctggtgtctctcccgcgtccctccaggacgctgccccatcagagcctgcgcagggaccacagctgcttagaacacgtgggctgccagtacatgggttcaagtcacagtcagaagccacagcagaaaatgggaagcattcctttatttttccaggctttttttcttattttattttaaagagaaaaaatgtgacaaaatggtgaggatgctggcagcgccagcgttcccggcctgcactctctcctggcctcccctcggacgtcttctgcagcccaaatctgaacagcagtgaaaccgtaaacatgccccccaccagctgccgtggcctccgcccagacccttgctgcccaggctcagccggctcctcctgtgccctgtgaagtggcctcgtgtggaagcccgtccataatgctcagtggatttcctctgttctctccgcaggcaagcctgggacctggctgttgacatctgtctgtctcagctgccgacgatcatcgaggaaggcactgcgtttcgggtgagtccctccaagggcaccctgtgcatccgcggcggcagccacttctctgggcacctggactgcaaagcccccagactgggggtggtgcccaggactctcgggtgtcagattttgttcacctgcctggaaaaaatgtagttgccagagtttaaaacatcgagtcaaccagggtttaaagttaaactttgaaagaatcaacttttaaaacagtcctatctcaaaattttgctattacagatctacttttcttaatgcggactcactccctgtgagtggtgatcctgttacactttctagccttttcaccacagacgcgttgtggatctcccccaggcctctgactctcagccctgtgggacagtgacccacggggggtttggtgctgaaccctggagggcgttctgcccccggccgcactgcacgggcgctggagagctgagccaccctacggcggaacctgggtttagtcgccgcacctgcaagtgagggtggccccgggccttcgcggcagctccctaggaccccctcgtggtttcttaatgagcttttgccttacgtgaggcgccaagtctgaaaatagataaataagacggaggccctgccctccagaaacccgtgaggaaagaggagcctctcacatctgtgcagaatgcaagggagcaatcggcaagagggcgcggcagacacggggaggccagggatgggggaggcggcagcctgggcagaggcaggaggggaccagcatccccgcctcccgttggggccacacctgagacaccaccgtgtcaggctccagagccacagagcctagctttgccaccgagggcaagtttggtcgtctcctcatttaagggagggattatggtggtatccaaccccaggggtgctggaaggacaaagggagttaatgtaagaaaagtgctttggacagagcccagcacagggcccttgggaattcatgtgcaggcactgccccagagccagctgtcactgatgtgaggatgccaccctccagcccagggcaggggcaccgatggtcaggaaggttccgtccactgcacagacttttaactttcagtgcacaccacagccgtcagggaagcttttaacacatgcagtcgggagcctgggtgtgcctgcgtgcgtgcgtgtgtacgcgtgagtgggtgtgcatgaggtgtgtgtgatgtgcctgtgtggggtgttttaactcctcagatgattttgacatgtcccacgggtgggatgactgggaaaacggccttttaagagggctttcttttttataatcttctgttaccctcccattattgcttgatttttttggtaacatttgattgtgaaaattttcaaacctacagcaaagttggaagaaatttacagtgagcaccccatgcccaccacttacttctaccccatctttgtattcatggggtattttcaagggcattgcagaccgccccgcattttacaccgtgaggcggaagccagctccccgtcatgtgcttggcatcaacactgggcttctagacaaaggccttccctcccttcctgctggaccacaaaccttggggggcaatgacagggtctcctgcagagtggcaaaccttcacagacgccagctgtccaccctcagcctgccagagctgctttcagagtgcctgcgcttttccgaagagctctgggcctgttgccgcaaacagatatttggaaaccttcgggaaactggcctttctgtactctgagcgtggcttcactcggtacttttaagagatcagaataatctgctcttatataaaataatgcagtttctatttgcatgtgtgctctttctaaacgaatacttaggtttctgtgccaggtatctttgccaagtttcttttcaaggattttactctatctatgctaaacaactagaatcaatattctgcatttgggaatgatttcaccatgttggggtgtcaggacaagccggggataactgacgtggaccacacactaggttccttttgtttttaatcttattggaggtgtaacttacatatagaaaagtgtacacatcatacacatacagcttggtgaatgtttcaagctgcacatactcgtgtaatcacacccaaatcaagcagccccatgagccccctcggcgcccctcttagctcctcccttccccagcagtggccgctttcctgcccagttttgtgcttggatgcgtggagtcacgcagggtgtagtctttgtgcctgcccgctgtcactcagcattgtttgagtaagctcactctctctgcaccgcagctcacactcaccgcacggcagctcactctcaccgcacggcagctcacactcaccacacggcagctcactctcaccacacggcagctcactctcactgcatggcagctcacattcaccgcatggcagctcactctcaccacacggcagctcactctctttgcaccgcagctcacgctcaccgcacggcagctcactctcaccacacggcagctcacaccacggcagctcacactcaccgcacggcagctcactctcaccgcacggcagctcacaccgcacggcagctcacattcaccgcacggcagctcactctcaccacaccacagctcactctcaccgcacggcagctcactctcaccacaccacagctcactctcaccacacggcagctcactctcaccacacggcagctcacaccacacggcagctcactctcaccgcacggcagctcactctcaccacacggcagctctcaccacaccgcagctcacactcaccgcacggcagctcactctcaccacgccgcagctcacactcaccgcacggcagctcacactcaccacacggcagctcactctcaccacacggcagctcacactcaccacacggcagctcactctcaccacacggcagctcactctctctgcaccgcagctcacactcaccgcacggcagctcacattcaccacacggcaactcactctcaccacacggcagctcactctctctgcaccgcagctcacactcaccgcacggcagctcacattcaccacacggcaactcactctcaccacacggcagctcactctctctgcaccgcagctcacactcaccgcacggcagctcactctcaccgcacggcagctcactctcaccgcacggcagctcacactcaccgcacggcagctcactctcaccgcacggcagctcactctcaccgcacggcagctcactctcaccgcaccgcagctcactctcaccgcacggcagctcactctcacagcacggcagctcacactcaccgcacggcagctcattcaccgcacggcagctcgctctctctgcaccgcagctcacactcaccgcacggcagctcacaccgcacggcagctcacactcaccacacggcagctcacactcaccacacggcagctcactctcaccacacggcagctcacaccacacggcagctcactctcaccacacggcagctcacaccacacggcagctcactctcaccacacggcagctcactctcaccgcacggcagatcactctcaccgcacggcagctcactctcaccgcactgcagctcactctcaccgcagggcagctgacactcaccacacggcagctcactctcaccgcgccgcagctcacactcaccgcacggcatctcactctcaccgcacggcagctcactctcaccacaccgcagctcactctccccgcacggcagctcactctccccgcacggcagctcactctcaccgcacggcagctcacactcaccgcacggcagctcactctcaccgcacggcagctcacactcaccgcacggcagctgactcaccgcaccgcagctcactcttaccgcacggcagctcactctcaccgcacggcagctcacactcaccgcacggcagctcacactcaccgcacggcagctcactctcaccgcaccgcagctcactctcaccccaccgcagctcactctcaccacacggcagctcactctcaccacacggcagctcacactcacggcgctgcagctcacattcattgcaaggtggacaccattgagtgtcccaacattcatgtgtcccttctagggccactgggcattttcagttttcagtcctcactaacagtgctggctagagccagactctgtcacatcagagcctgagacaaaagggaattctgtgatattggtcctccctttgaaatgtcgatatcttcttcagtatggatttttgtattaatttttatttttgtaaatattgcactgaaatatcatttgtcttgattactgatttttttttttggtaccccacctgctagcaccaattctgtgcctgaggccaaggcctccccttcctggctggcctcccgttcaggggctgctccctccttcacatttctcggagtgatccttcggggtcccagggtttgcccatattcagctttaacagatggtgccagagcactctgcaaagtggctgagtcagtttacactcctgcctgcagcattcgagagttttagttgctatgtatttatttggctatgatggttcagtatgaaaaggtatttccttaagagctaatcgtgtatttacccgatggttaatagagcattgttctatacttgtactggccatttatggttccggcttttggtatcctgttttatgaaacctttatttcctctgagatgagcattctgagcagacgctacgctctttgtcagctagcagcttgtgtgtttccctttcacatctggacctgcatctgctcacatttcacgtcccccgtgaatgctcggcttactggtggtgtttgcactgaggaccgtgtccgcgtggctccctctgttccctcctttgcaccaagggccatgttcacatggctgcctctgttccctcgtttgtccctttgctcacttgttctttgcaccaggaccacacagttgtaatgacaaactctacgtgacactttctaagctggtagactaagtcccacaacttcgtttttttccccgagtttgcctcagttacttttggtcctttgcatttccatgtgaattttaccatcagtgtgttaatttctgcaaagaacctgctggatttttgttgagattacagttaatctacagattgatttgggagaagtcaccacctctataatattgagccttctcctccctcaacgtggttgtaaatggtattgtttaaaatttcactttctgatttttctctactaacagtgacatagaaccctataaaaattgaggttttcagaggctgaggcaggagaatttcttgaacccaggggcagaggttgcagtgagccaagatcatgccactgcactccagcctgggcaacagagtgagactctgtctcaaaaaaaaatttttttttttggtttattgagatagtaggagaagccagaatgattcccctgcagtagaaagctcgggctaattgactttcttaggggtgttaaagagaacccttctgcaaactgagcagccgtacagggggatagaatgtccctacagagccgtacaggggggtagaatgtccctacagagccgtacagaggggtagaatgtccccttggcagtgaactttaagtcccctctttaagcagcaagcttgtcgtaagtggcaaatgtattgtgccattgtcaggacggagagtagccatctcagaatgtccagatggtgagaaaggcggcaggtatgctcaggttgttggtagcagaagtccagccggacgggctccacttaggtgtgacttggaggctcccagcctctcagccggccttcccattttcagtctgctgcccctgtttttagaatatgtcaaactgcctagcacacaggctggcaacagagcaaaactcctggcatccaaatcgccctgggagagccaggtatgtggtcctggccgggcaacccagacgctcagcccagcaggacctgtgagctctctgtctcgctgaatggacttcgctcccctgcacgcaggggccagctcaggagctcttcatggggtggagaaaatctcagagatttggcccaaaacatcagccctgtgaatcatgggtggagacacgggccgctctcgagatgttttccggaatatcatataaagtgttggccactcttccgcaggcgcttgctctaattcgtcagcctccccgtggctttagggagcttcacgggcttcaccgcgcacctgccaggcaaaggtgtgcttttccttttttgtcagtttgaggtgaatagtcaggaatttttctctttctgcatggagtagtgactccagcagtgaggaacatgtgaaaatccatcaggcaaagctaatgtgatagaaagaagaggtgtaactatctgaattacctgacttctgttcacagactcaagccttctctaactcaggagaattacgttctcgcgggatgtggaggagggggtacttaacgagatttttttttaaccaatttatgaataattcacacttgaaaacaggaaaatcactctgggggctccaagccagctccacaggttgccctccaagtgtgattaactttctgtaagctggctgcacaggagcacggattcctacgtggtgaatgttctcggctgactttttaagtcgggccacggggctctgcccgccaggctcctctgtggaggctgccgagagcgctcctggacttgggcgcacggaggcaccctgtcctgctcctggcgttcgcctgtccacatgtgtccacattcactggaacccggggcacagccgaccccggccagatgagcggagggagggttcctcccgacctcctctcagagacacgcacctccactgcggccacccaccttccccccgagcaaaatcaaacaacgtagggaagagaggatagtggatgggagagagaggctggtagttgtttttttttttttctttaattctttgtatcgggggctcagggaaggcagagctgtgtgttaagtggaagtgactctccgtggagggaatcaggccggactgctcctgcctggccgctcagttccgagaccttccaacggcagcctcccctgcagccttcacgctctccagccgcaggcccagcagccctgctgcccacctgctccatggcacccaggcgaatccccctccactctgtgcctgcactcacgtggctgggctaactgggagctcgggcccacccggtgtggcccacggagaactcgtgtcaccccctcgaggggccctgatgccgcctgacattctgaccccaagcattttttttggtctccctcacccgcgcgccttctctgtccagctgcaacccctcctcccgccctcaccccagagagtaccctcgtttcccatttcactgaggaaacaagaagcagtcgcatgaccgcctctgccgggtcctccagccctccccctgcttctctgcatctgggcccccttgctttgccgcctgcctggttcccctggggagcagccctgctctgccagcccagcctgtgcttccagtcccatcccccagcctgcccgaggatgccctccagcagcctttccccaccctccgtgcccccagctgggtctttctcaccagcgtcctgtccccattactccacatctacaaaaagcacttcctgaccctacatccctctccagccaccacctgtctgtcttgttcccctttgcaaccaaaaccaaattcaccctgtctcgaaacccctctggctgcgcttttgcccaactccagagcgttcttgctgctgatccggggcccagtcagctctccatccttatctcgcctggcccggtgctggtttgtggctctgccctggacgttgctccctggcgtccagacctttgagctctgctttccctccactgccgggccctcaccggccccagcgcggccccagctcatctccttggtctccatagcagaggctctgtcctgggcccctttcctttctcacttaacttgaaaaagattcacacaccatgactcccaagcgtgtccccagccagacttgcctgctgatccacacactcacggggtcccctgcccccggcatcttcactcccttgtccagccactgtcgtgagcaccacatgtccacagctggttcccagcacgctcctcttgcggccccagctcggtgccctggccaaaagccttggagtcatcctcagctgctctcttctcctgcctgcctctggtcccttcgtgcaccccgcaggctctccctctttggcatgcccagagcgcccgcttctcagccgcctggcatcctcgcggccctgcagggcgggcccttcgtgaaggcttggatgcccggcaggtggcaggggtgggcaagaccaggccatctgggaacatggccctaacaagcacctgttctgcttgccccgcagcacagcccgttcttcgccgagcagctgaccgcattccaggtgtggctcaccatgggcgtggagaaccgaaacccacccgaacagctgcccatcgtcctgcaggtgagtttcttcagaccgggccagacagccgaggttcctcaggaaggaagccagatgcctgtacagccccgggagtgccttctctctccctgagccctgtgggtctgtgacatcccagcccctctgccccgaagatgatggtgcatgggcaggtcgcattcgggcaaacggatcacacagatccaatcaggagtcactgggctgatcgcacattcattcctaaagggtttcctctaaagccattgatttccctcctccaccctcagataagtgtaactttgggactggggagtcatcagccagtccatcatccccctctcccctggctaccatttccactttaggaattgctgagattcagctacagatgggctttgcttcagagcaggctctcgacaccactgcctccttctcttgggaaggacaggagatggcagtgaatccgggagaggagggaggaggctccctgagcggatactgaccggcgaagcgggcagagcggctttgtggcccagcgccgtaggttatgcactgaagcacacacagatccggaagccggcagcccttcccttgcacggggctgtcacagctgctgtaacaaataggcccttttggggcacgtccttcagatgccagtgcccacggggcccgtgtcatgtcagtgctgttcacgtgcagaccatgacctgttcatgggttgggaggtcagcatcgtgggtcctgctggctggtttttggtcactgagataggatgggaggccatggaaattgaggagttcgtcacaggtagtgaagttagaaagattccacagaacttttgtttcggtgaatgtgtgtttgtggggaagtgtgtgggctgagtcagagtcaaaggagtttaaaatccactggtcagtgtagatatcaaggtctaagaactcactttaaaagctggaaaagtgtttttgtgattggggtggtgcagttggactttggcgaggagctgtgcatggccgtggggaggggctgcccagcagcaggcagggaatgagcaggccccgccctttttggtttaaagctgggtgactccccccacacacaggaagagccccacctccgggtgtggtgctgagttctgagagtcggcagagttgggtcctcgccttcctagaaagcagatcgggtggtggtacctccatggagaggggcgtgagtggcgccgcccacctgcccttcttccttccagagctcgtgctttctggttagggccgctcaccacactgacagacagcacaccaatcttcactagaccaggtgttcatcccacctctgagagatcatttagaaaaccggggccagtttatctctgtcacggccatggcctcagcagccttcccttccgccgttcagtctgtgctgcagcagtggcagccagcgtcgcaggcgtgctgtaggactgaggcttcacctcgttcaggactttgccccaagaatctcagccagagaaagaggagttgggagaaggaacagtgcacatggacgtgctcaagacagtaccgccggcctgtcctcgccggcattgtctcaggcgggcaacaaagaaccagtgtgccagccggctgccctggtgttatgatcccagctcctcagtaggccaaggcggggaaggatcacttgagcccaggagttcaaggccagcctgagccacatagggagactccatctctacaaaataaaataacattgtaccacatttcacagtatatatttctgctgctgtcagtatattatgacagttgctttttggacattgcaaaaagaatgcagacgttattactgttcttcctgtatgtacctagattcgtttaagactatcctgagattacagggtgaggtgtaaacaaataaaccagctcatgttcaaaaccaagaacacgcagtgatagcagcaacgcaaccaaacaacatttgacagaagcccacgttttcccttcgtgcgactgtagaaaggcagctggctgtgtggccacgggtgaccgggggtggccacagcgcaggttgcccatgctgggccccacggctcctgttggtcatctgggttaccaggatgtccctcaggagacactggctctcttactggccttcctactatttgagcaatgtgatggagtaaaatcggccctctccaaagcaggacccgatgccaagcacgttaaatccagttcttttgggtccagcaaataatctttttgtaaatggccttctgttgatttctttcaatgttcccttggccacccacactccctcaaggaaggagaagacgtgctggaggcagctttctgatggtgacgtatgcgaagacagctctggtcggagcgtggggcatttcccacatgattttccagcaggtgtgagtggcaggttcctcctccctctggagggtctgtttcctggctgtgcccagccgggatcaatgggcggacctccacctaacacaaaagtagggaaagatgaagtgtaatggggtatcggcttcatttgacgtaccccccgggagtggcttctttctcgttaactcggctcacttccccgcgctttctcttaaaagcctttatttttgccaaagcctgggccctgttatccttaaattattctctagtgccttggcaagtcagaaaacatcacttaagggaaagggagttttctcactcgcttccggttttccgaatccctgccacttcatccctaagccagaggcagtggctggtggccctccagggtcacgcacggtgtctcatcaggtccggctgattcgcagcccctcctgtaaacgtgagcatggaacaggcccttcctgctttccagcctcaatatcctctctgccttttaaaaatataaatcaacagaggaacaagaaggaagatacaatgtttaaaaaaattgctgttttgcccagacccttgattgatggtgtctatttttttgagatggagtctcactctgttgcccaggctggagtgcagtggcgcggtctcagctcactgcaacctctgcctcctgggttcaagcaattctctgcctcagcctcccaagtagctgggattacaggcacccgccaccatgcccggctaattttttgtatttttagtagtgacaaggtttcaccatcttggccaggctggtcttgaactcctgaccttgtgatccacccgcctcggcctcccaaagtgctgggattacaggcgtgaacgaccgcacccagccctgaacaccgtcttctcacgaggagctctggactctcgtggcctgtggggtgcgtttgccctctggcttcggcagctcgcccggaactcagtgctgtgtgcccccaacaggtggctcaggaagcccaggcaggggaacgaagagcgcctaggttatggaagagaggggagaaagtgacttttcttcttctttctttttcaggaaaaaggtgacagtgatatttatgtgttcatttatttacttggccctttttcttttcaatagatccagggtatacgggtgcaggtttcttgcatgcatgcactgcgtagtggtgaagtctaggctttgggtgaacctgctacccacatagtgggcattataccccataggtaatttctcagccctcagcccctcgcaccttttggagtctccggtgcctgttattccacctgtgtgtccctgtggacccgttgtttagctcccactcacttatacatgagaacatgcaacagttggttttctgtttctgagttattccactgagcataatggcctcctgtttcacccatgttgatgcaacagacacgatttcattctttttctggctgagtagtattccatgatgcacagacgctgcagtttcctcatccagtcctctgttgaggggtgatctcggctcactgcagccggagctccgcctcctgggttaaagtgattcttgtgcctcaacctccagagtagctgggatatcaggtgtgcaccaccgcacctggccaagagtgattttataggatgaagttttagtcccttttcctagatgtcacagatcagtgtgagcatttcattaggaggtctatttgctctctctccgtgcatcattttttttacaaatagaatgtggggtctgaaagtacaggattgttatcaggtgacagcagaatgacaaactagagtgatgttatacataccatgtacatcggggactccaaaaccgccctgctcatcaggtgcccgaggcaccctggcctgcagcacctggcactccagggctggaactggagaatcttttcttatgaagcagctcttccagtatgcctgtctgagcactctcttcatatacaaggcaaatgaaatttgataaccttagcaattctgttttaatttggtcgcctcagctggagtgcagtagtatgatcatagctcgctgcaacttccaactcctggggtcaggccaccctcctgactcagcctcctgagtagctggaactgcatgcatgtgccatcatgcccggctcatttttgtattttttgtagagacggggtttcaccatgttgggcaggctggtctcgacctcctggcctcaagcgatcctccagcttcagccttccaaagtgtttgcattacagtattgagcctctatgccggccaccatgattaatctttagtttgggctaccacaggtggaaaataaatctcagtaactcattcagctcaccatcatttacttctataatttccatagatcgtgggatggtccggaacaggaggtttttgttttgttgtttttaagtacagaaacaacattggctttttttctaaaagccaatcccattttaaaaataactttgctttatgttggcttcagtttttaaaaatcgtaaatcaacaaaaggtggcaggaagatgatgtaatgtttgagaaaaaaaaaacagtacttaacctttccgccaatactctttattgacgatgtttctttgcaaatgaaataattgtagcaccaaatcccatgctgcccaaggacctccgacgccgactcccaggcaggtgggcccccgaggcccccgcgtgtgtttcatcagcacctgcagctcctacagtgggacactcgggaccacatcacggtggtgattgtgaaccagcgtcccgcttgcttttgttgtttgtaaggagcacattctaaggagacctttattgctgggctagtgtcctggtaaaacagtaacaggaactggccttgattagacctcttcgccccgtcctgccactttttccatttgttctgcaactatttaccttagaaacagccttgtccttatttacagtgttggaaaaaaacaaaaagaatcagaaaacaatctttgtaagctttagatctgatgatgtctttgatttctgacgattgcagccatggcgagacctgcctcctctcctctccctgggtcatctagaaacttgagcctcaggcagcctagtgttccctacacacagagagtcagtccttaaaaccttgggtggtggagacatctggtagccgaacactatgatgctgactttacatccgctggacaccttggtgcacacagctttgtgctagacgctttacggactctgcctcattgaactttgagaataagcccaagtcaagtactgttgtctccgtttttcttgataatgatattgaagtttccagaagttaggaatctaagccaattattgggcagagatggaggcagggttaacatcaggttagccggccccagagccagtgcttttcctccgactggcccctcaaacctgagttccaggcagcagtggcatgcgacagcccccgagttaagcataggagagggatccggttccagttcacatatcctgcgagcagtcccacgttcctttcccagcctcttaatcagagactctcagcatcaccagcacggggaacctgccactcctgggtccatggtgaacccagcgtgggagctggctccgggcacatagaagggaagtgaggccacattcccactgctctttctctgcccccaaggctggacatgctgggatcccctccataccccatctgcccctccagcctggctagccacctcctcttgctgccacctgtgaccttccctgtccccctcatcctcctgccagtgctcttctcccaccacagggaagctcctccctctccacggctccccagggcccatgctcctgactcggtggctcctccgtggaagtcgtgctggccgacccccaggagcttgacccaggtggccgccatctcctctcccctcccccgatcctccaccctcactggcctcctcgtccctttcccctgcctctcttgagggttttcaaactcatcccaaaccttcttttctagagtttgctttccttcaccccttcttctctcagcctctggccagtgctgcagtctcctcctccccatctccgtattggcaccctggtcaaacccacccccttccactcgcctccccgacttccagcctcttgccaggcctgtccccaaagcgagcacactggaccagtcactgctgcttaacgtcggctggtggcttctggatctcaaaacaaactgacctctctgcatgccgtcggcggggcctttccctatccggcccctcccccatcactgacctcagtcatactggtagcccgtgcatcctcagacacccgggcttttccagcctctccacctgcaacgcggtaaccccctcatgtcacctccaggacccgctgcccagctgtgtcctgtgcatcttctcctggggggagggaaaacctccgaggcctgcagcgaggccaggtcaggggctcccagggtctgtgtgtttaggcatggtgatggggcggtcatttgtttaatgtctgtctcccaggccacatgaaggatgggtgaggtggtccctactgtctgtggtcactctcctagcacccagcgcagcacctgccccataaacaccccttggatgactggggcatcgtggatagaaatgctgtaggttggagggagtcgatgcacatgccttccagcatagccaccattaaggaaaaaatcaaaagaagtaatgccattaaaagtgtaaagcttggccgggcacggtggctcacgcctgtaatcccagcactttgggaggccaaggcgggtggatcacaaggtcaggagatcaagaccatcctgcctaatgcagtgaaaccccgtctctactaaaaatacaaaaataaattagccggtcatggtggcaggcgcttgtagtcttaactactcaggaggctgaggcaggagaatggcatgaacccgggaggtggagcttgcagtgagccgagattgcgccactgcactccagcctgggcgaccgagtgagactctgtctcaaaaaaaaaaaaaagtgtagaactttaatataacagaaaaagtatgtgcaaaacctctggcagagcccactctaacttataaagaactctgacatgtcaataagaaaaagccacattttgaagtagaaaactaaacgcatgcagggcaagtttactggggaaatggcccatcaacctgcaaaatgtactccccttgaaatccaagaaatccagatgaaaaggatgtattttcacctgtccttttggctaataatagtgtaatatgggctagtattgtcccacaagctttaaatttattatttaatttaatgaaacccttgtgggcaggtgttgtgttatatgtgttttatgaattaataaatcaaggctcagcgacgttaacttgcccagagtcacaccgcagtgagcgctgctgggtgaccagctcaggcagcaggaagctggtgcccacgtgcgtgccgtcgagagtgtgagtgggttcagcctcagggtcatttggtaacttaagtatatatgctccgaccttacctttttaatactcacatttatcttagtggaaaagaatcatgtacatgtgccgatgtacccattaggatattgatcacaatcttctttatcagagcagcattttggccaggcatgatggcccacgcctgtaatccctacacttcgggaggctgaagcgggagggttgcttgagccagaagttcaagacctgcatgggcaatgtagtgagacccccatctctataaaaaatacaaaaattaaccaggcatggtggtacatacctgcggtcctagctactcagggtttgaggtgggaggatcacttgagtccaggaggttgaggctgcagtgagccatgatctggcatctatactctagcttgggcaacagagcaagaccctatctcaaaaataaataaataaaaatggtaaaagtaggaacattttgatgataatttaaatatctatcactggggaagttgtttaaaagaattgtgtacatttgcataacggaagtactgtgccgcctttgggaataatatggtcagtacatacctactgatatgaacaatgttcacagtgcattgtttagtttaaaaaggagctgagaaatagaatcacatattatctagttcaagatcagtaagagaagtgtggacataaagaacaatgtctgagttcatatacctaaatgtcaccagtgggttagctttttaaatgcaattaaagcatgtttgttctagtattttctacattgagcatcttttatctgtgtaataaaggcataaagcgtgttttcttcacctgtctaaaagcatgaacttgtaaggaaaggagcaccagctctaggtaactgaagcagcagacagatctgaactgtggtcagaccgctccaaagctggcagctcatgcagcagcgtttcggggttgcacaccagtatggtttgcagtgataccattttcttcttgttcttccaggtgctgttaagccaagtgcaccggctgagagcattggacttgcttggaagatttttggacctgggtccctgggcagtgagcctggtgcgtgccttccgcattaacctgggggctgagggaggtgggacagagattaggctccgtgtttcagtctgtgcacgtatttcatgatccagagccacccccagccgtgagacccagggcgagtgtgtccaccgtgttggtgtcctgtcactcctgaggccctcaaggagcccactctgtacccgtgcagcctgcagtgctgcctggcgtttgggggtctggggttgtcgcccctctttatgtctgatgttagacataggagtgagtgtgttgtcggccggtcaccttttcctgagccgcccccagcgctgcggaggagcagggcgcccctgagcctgacgcagcacccacctcgtggtgctgcttcccccaggaggagtctggatcctcagcactgtctgctcaccatcatggcaggcacaattcggaaacgctcttctggttcctcattctatagcagagtagtaatggccactaaaaacaccctggcagaggcaggatcaagaagcgacgtgcgtttaacaaataactcacagggaaagtaaaaggaggctgagagggaaccacagagtcaaggaaactcgagagacctatggccagctgccatgtacagtaaaccttacttggttctgttgaagttccaaaaatgaatactcataaaacaattagaaattttacaggtgctggatttatgttattcaagaatcattgttcgtttttcttgggtgtggtaactggatcatgtttttataaaagagacctaattttttagagatagacactgaatattcaccaatgaaatcacatgacatatgagccttaatttactgtgcttgggagcggtgcggtggggcggtgggtgcggaaccgctgtcactagctgggtggtgagtacctgggtttggtgtatttaagtattttcatcagataatgttgacaaagagtggtaattgatagtccagcactgaaggacgagagaaaacatccaaaacttggaagaatcattcagcactcaccactgggccattttcactccaggtgcctgaggccacaaatagcttgtaacagagtcagggcctgagtcatcggaggaaggctggcgtgactcggtcacttggtgtgtgcgtggtggtgtcgcttagtcatcctggaaaggcctgcgtggtattgcgtgcactctaagaagacaggaagcatgtattcataacagtttagaaagagtttcatttttaaggttaattttttaaaaccagtttcttccctttaaagaattaagcttctgctcattggaaatttgcctaatacatgaatcgaggctggataaacgaggtatttttacaggtacagattttgcctctcaggtgagggcccagccacccgaaccagagaaactgctcataccttgttaaatgtggcctttcacagggaagggacccaggcctaggtcccaccaccacctcctgtcttggttacaggggacctcacttattggaaggtgatacctttaggatatctttgaaattccagcagctttgagataaggacacagcagaaacccctggctgtggagtgcagcagtactttgccaggcatcctccacactgcagtgccctccacgccctccctcccctgcctctgagggcagagagtcccctgagaatgacatggccagaactgggcgccagtgagcccctgggcaacccccgctcctccctgcctttcccagggcaggcatctttctcccaaggtgtatctgaagtgcaaacatgagtgttgagcaagctggccgtgccgtcacggagaggtggccgtggtgtcacggagaggtggccatgccgtcacggagaggtggccgtgccgtcacaggtggccgtggctcgtacgtgagcaacacagtgaaggtgcctgatgctctgctgccaagagcagacgaggccactgagggcaggcaagggccccaggcgcaagcagcctgcgcctccacaaggaaaagctgccacccgattcattccagtctcttgacaccagtcaaggctggcagtatgtggcagcttctaggaataaatcagagatgaataaatctggaggaagcccctctttactttaagtgaggcccattcattcctgttgcgtttcccatatgtgctgaagatagcaccgcagctggtcccgcgtggcacccctgctgctgcccgttcccttgctgcggcacaggtgcgctgacgccctccctcgcccccaggccttgtctgtcggcatcttcccctacgtgctgaagctgctccagagctcggcccgagagctgcggccacttctcgttttcatctgggccaagatcctcgcagtggacagcgtgagtatccccgccctcctccccagagtgatgtgaacctgccggcccttctggggatgccgagccctgcgtttccagcctgccctttctccagcctcgctccctctccaggcaccgccgttcccttcctctcttctggggtaaagtgggacgcgcccgcctcggcagccacctctgggtcgtgggggctgtcacctacctgtcctgtccctggccttcccctggtaccctgcgctcagtccccccacaccgtcctgtccctggccttcccctggtgccctgcactcagtccccctgcctgtgtctgacccccgtaaggctgtccccgtgctcctgaccctgactggaagcaaccccgccatggcataaacttggcctctgcctcgcccagaccccgcattggctctcctgtgcccaccattgcatttctccccctcctcaaccctgcacaggtggtctgggccaggccccgaggtgttaggggccacccccttacacggggctgtccagctctgtcctctctgacgggcatcagccctggccctgcagccatgtgttcgcccctcaatcatctaggccagggacccatatttagctatgttaagagagacacaaggtcagctgtccctgtccccagcggcttatgcttgggtgctggcaggggttgcaggtgacaccagccctgttgtgaggcagggtcacctcctgcaggagctaccagcgagatgggtcagaggagtggggctgagaagtcgtgtgggcgagacccggcctatgctgaactggaaacgccaggaagggccttgagggggtggatgtcgggcgggggtccaaacatggaggtggcagggagggctgggaagacatttagaggagggcaggccactccctgtggctgtgtgcggggacacgcagggaggccccatccacgcagacggtgcacggttcccggtagacacagttgaacttcatttagcaggcatggggattattacagattttggaacaaagacatcaaagaatgaagctgtggtttataaacattgcctggcctcggtgtcaagtggattgtagggaaacacggggtggagagcattttcctccaggagggtgggcagaggaggtcgggctgcagggctgggagggcggcaccaagcctgggttgggagaggcgactcgggctgaagcctgtgtggccggctggggctcggggagccttccagagacaactggtcaggagccctgtgcggcctaggagcagggctggcccgatgccaagactggggacctcgtctacccagtggtgatggcaggcgagaccctcgaaggaaaatgtggaaggctcagctgcgggagaactctcgaaagctcctcgtgtgacacagtggagaggagagctgtacagagtggtgcaaagggtctgggaagggctcatttatagaacgtgaagattctagaacaaagggtgtgtgctgagaatggagttgggggatatgttgccctctgcagggttgttggggacaaagatttcccagagatgcctttgcctttagctgtccgtgtgcggaggggcacacgtgtgtgatacagagctgggctcggagccaggttggcagggagccccgggaagaagccaagtcagtcttgctctgggggtgccgccacgggtgaggagagcgggacggaggagccggcatcagggcaaggctggctttgctccctgcttggttttgaagcaaaccagccccagcaactcattagaaggcctgtaggagcaggtccacgttccccccggacttcggccagctgctgtgtgcacgtgtgtgcgggggtggtcatgtatgtgggcgcttgtgcgtgcatgtgtgtgtggcgccctgtcaggcggctttcatatgcaaagtctcttaattcctaagtcccctgtgaagttagcttgaatttgcagcctatttactggtgaggcgccgcccacaggagggagcaggggccacatagctgccatgcgaggggccggcaccccactgggcccctgcgccgggtctggagctccttgcccacacagggaaatggaaggtctagcaaagtcacagagcaagtacaggagagtgccaagaacaccttggagaggccatggcttggagccggggaagaccaccctttccttttctgtgtggcaggtgaggggagagtggacggagcttaagcccccggggctcctgcctgctgcccggcgctccccaggccacattctgtcagctcctccgtccagtcactggcactgagacccagcctcatccttagccctgtcagccatgtcgcactggccaccaggacctgctgtgctcgctgaagctgccctgttgggctttgttcagccaaattcactgaccctgttgtccaggcactggcaggcaccccgagccacaggctcgtaccccgcactgtgcgctctcacccgtcagccctgcacaccccacacaaagccactgctgtgtctcccacccacagccgctgctgattcaagtccagcccaggccatcaggtccccaactgtgctgcccacggacccctgggcccctgctcagcccttctgctccctgcacccagccctgaccatagcctccccacaccccaagtcctcacgtactactttggtgtcacagctgaagtcagggggcagtggggaggctgctgccgaagcggacggtgagggcttccaccttggaggcaggcgtcagtcgtacccagcaccagttgacctctcgctggttccgctgattcttgtagattccctgggattttctgctagttcactggttcttgtagattccctaggattttatgtatatgctctctccaagcagaagcagcttccagcccctcttccggttctgggatctctcactctttttctgggcctggggcactgaccatggctctgctggcacgggtcggctaccgtgcttgccatctctcccagctgctcctgatttcctgagctggatgcggggagctgctgctcttcctctcagcacagctgaggttgaccttgacctcagttcaaccttgaaccctcctgggcccagtgctctgcacctggctgtgaccagagaacgctccataatggtgacctgaataccatatatttcagcaaaatattttccctgctacccattaaactacagataaagaatgactgctttgaaagattggctaaagcactggatttaaggttaaaaccctgagtttgatcccatcaccgcatttgctcttacaagtcattttcacttcccttggccatgatttgcctctgtaaaatcatgagccttcggccgtctgccttcagccacagttccagagctcagaaccaggacgtggaaaactgctgtgtaaattatagaggaacaggaacaggaccaggaaggggcaccacgtaaatctcacatctctcctgcctgtccctgttacactaaaaccttttcttgctaaacagaaagcttggctttgtggatcaggacgcgagaggtgtgggtcatttctattttactcttcttcaaattcactgaagagccacattatgtaaacaaagggtgtttggcaggaagtcattttgaaacgtggtttctgtcctacacccatatcttcgtcatctacatggacacacttagaaatatcttggcacctggccacggatgaaggaccatgtgtaggggctctgggatgcacaaaacggtgaccctcacatgacacaaagcccagggtgaagggaggaagagatgccatctgcatgcagaggtctgggattacggccgcctgagcctgctccccagcaccgccagtgctgcaggaacgtgtctaagccaactttgattctcagacttcgtgtttttagtaccttttaggacctggaaattgatgatgtctttatttttagtctcaggggtggctcttggtgaaaggggacagccttcctcgtaccttcctcgtgacattctcactgcatccacagcccatcatggtattgcagtgcagggcgtcttgtttaaaactggctcttggtcccgtggatctcccagggcctgttgctctcgagtgccccaaatggcagaacgtggccatgagcacggaggctgcagcgtgccttcgttttacaccctgctccaggcagataccagggcctcgggtttattattcatgctgctgaaggggtcatctgctcagtactgcttggggagctgttcccacagccagctgggcatgcccttgcctgcagtgttcttgtaactgcctgcaggcatcacaggccttcctgtgaattaatttcttaaccagcttgttgcacctgcatgtttaaaagcaatcattccactgaggggcattttgaagtgtttccggtagaaactgagcctcgtctacctcacctgcctcgcccttccttccatcgttaccctggcgataacttcccagagatgaaagttccctgtgtttttgaggggtcattcctctactcccttcccctccccacgtctggccatggatgttgctggcggtcctccggatctccacccctacccccccatgatgtgtgcaccccctacaatgtgtgcatgcccctctgtgttggtgatggtcctccgaagctccgcccaccatgatgtctgctccgccccctcgtgttgctggtggtcctctggagctccgcccaccatgatgtctgctccgccccctcctcgtgttgctggtggtcctccggggctccgcccaccatgatgtctgctccgccccctcctcgtgttgctggtggtcctccggggctccgcccccacatgatgagtgcctcctgcagccctcagccgtccctgtgactcctggggcttgccattgtgcagatcggggtgcacatggtgtacagacgggtccacctgtgaagatcgcagagcctgctcagaggttcagaggtgcagacagaagccagccactcccccagtgttctcagcatccccctgctgccgccagccggccctcaggacacacttaagagtttgagaaggatcggagcccactcaggctgggcccagcggaagggcgagcctgggacctcccctcatttcccaagcacctttggggcacaccgtgtgtcccattgtgccagaagctctgagggattcatggggaggccttaaagaaggtgggctcgggcggaagaaaagacggaagaacaccatgtgccaccggggagaagtgtgtgccgtttacatgagacagagcagggcacagtggtgacactgatctgacacagatggtaccgcacaggacaaggagcaccaaggggggcacatgaagaaagccgtctgtccaggattctcccaggactctgatcccagagggcctcccccagcatcactccccatgccaggttacactccacttcacactaccagccagaaattaccaggcagatagaatcaggaaaatatgacccgtaatgaagaaaaggaaatcaacccattaaaacctgctcagaactgctgcaggtgttatcattagcaggccaggacattaaaaagttagaagtctactctacatattcaaaaagttaaattgagacacggagaatataaaaagaacccaacttgaatttctagagatgaaaactgcaatatgtgatgggaagaaatatacttgatgggattaacaaccagttaagcattgcaggagaaaacagtacacggttaggcacggggctcacgtctgtaatctcagcacttttggaggctgaggcagacagatcacttgagtaaccaggatttcaataccagcctgagcaacatggtgaaacctcgactccacatgaaaaaatacaaaactcagccatgcatgttggcgcgtgcctgtagtcccagccattcagaaggctgaggcgggagaatcgcttgagcccgggaggtcgaggctgcaaagagccgtgattgtgccatggcactccagcctagggaacagagtgaggccctgcctcaaagaaagaaagaaaatagcaatagaaactaacaaaaatgaagcatggtaagaaaagaaaaaaaaatttaattaaaagaatattattccattgcgggacaacggcaagtgacataacgtactatttgggggtccataaaggaggctagcagaaaaagtatttgaagaaacaatagctaacatttttttgaatttgatgacaattataaacccacagatccacaaagcttagcaaaccccaagcacaagaaaactacacgaaggcatatcgcaatcaaattacttgaaaaacagtgagaaattcaaaagtctaaaggcagccagtaaaaagccagtaaggagcaaaggtgagaatgacggcaggtttcttcttacagatttcctacagatggaaaaggtgagagtgacggcaggtttcttcttacagatttcctacagatggaaaaggtgagaatgatggcaagtttcttctcacagatttcctacagatggaaaaggtgagcgtgatggcaggtttctcacagatttcctacagatggaaaaggcagacagcggaacagcatctttaaagcagagagagagacagagaaagagaaaaaactgtcaacctagaattctatacccactgaaaatatatttccaaatggaggcaaaataaagacttttaaagacatacaaaagatgaaagcttatccccggcagatccacactacaagaaacgtgaagtcctttagccttgaggagaatactcttcagagggaaacacggttctacacaaaggaattcaaagcagcagaaatgagtactatgtggataaatatgggatttttttctttttatttaaatcttctttaaaagataattgttttaagaaaaataataacagtgtactatgaatttttttcaataagccttttgcactcttaattttttttccttacgagacaaggtctcattctgttgcccaggcctgatcaccgctcactgtaagctcacactccctggctcaagccatcctcctgcctcagcctcccgagtagccgggatcacgggcacaagccacggcaccccacagaatgtataacatttgtaagagcaaaatgcatgctaacagtaacaaaaagatggggaggagagagaatgaagaaatactattgtaagattcttggactttgtttgaagtggtctcatatcacctgcctgaagatgaactgcagtagtccataaaccctaaagctgccactcaaattttaaaaagaattacagttaattagctgacaacagagatgatatgaagtcataaatatagacaacacggaaggaaaaagataaccaagagtagatgtaacaaatagaaaaaggcaggatgatagatggacacctaatcctgcccgtcactgcagtgtggagactgaacgccacaatgagaaggcagaggccaccaggttgaagagcaagaaaaaaccataccatggctacaagcaatgtacttttggcataaagacacgagtagattgaaggcaaaaggacgggaagagctctgccatgcaggcactaagcagaggaaggctgcagggcctatgttaatatcagacagaggaggtttgggagcagagaacgttgctaacaataaagatagacatttcataatgctacggaagtccattcatcattcatcaagagaacgtcgcagtcctaaatgtctattcacctaataatagagtttcaaaatacatccaacaaaactgatggaactgcgaggagaagtagataaatccgtaattacatttggaggtttcagtgctcctttctcagtaactgacggaacaagcagaagagaaatcagtaggaatagtggggacttgagcagcactctccagcagctgggccctgacgtttatagaacacgccacacagcagccatgcagtgcacagaggctgtgccacgataggcccgacccttggccaaataaacctcaacaaatgtaaagaactgaagccttacaggcgtgttctacagccacagtggagtcaaactcaaatcaataatagatagtaggaatgtctctaagcacttagaaacagaaacttttagataaataaatgattttcatttcattccataaaattttaagtaaattaatatatatgtgcttaatgcaaaatagaatataaatatgtaatattaagatacatagatattataagtcgtgaataacaaagatttatataaaatatttattactataagtatgtatatataatatataatataatgtacatataattataaatacttgcattaaataaatacattatataaacatgtatattaagatataaaataaataggttgagtatacgtggacccagctctgaacagtgctgagaggggagtgtgtagcagctgctagacaatgcattggaaaagagggacggtctccaaccggagatcccggcttccacctgaagagggcagcgtgagtggagtaaacccaaagctgtcggccaaaggaaatgatacaaatcagactggagactaatacgaaagaagacagtgaaacatcaaaatctgttgaacaaaacatttttttaaaaaacacatgaataaaactgtgaaacaccaccctgactgataaggaaacaaagaagacacaaattccagcatcaggaatgatagaggtgacatcatgaaagattctagggatattaaaaggatgataggcaaatatcatgagcaacttgatgggagaacatttgataactttgattccttgaatgacacataccactcactgaggaagacatcattaatctgaatagcactatgcttcttttttttttagagactgggtctcaccacattgcccaggctagttttgaacttctgggctccagcgatgcttccaccttggcctcccaaagtgctgggattaaagcctgagtcactgtgcctgtcactacaagtggaatttgtagtgaaaacttttactacaaagaaaactgcaggtccagatgacttcgccagtgaattttactgaacattaaggaagacgtatttggatgacatctaagcaccttcccatattgttctatgaggccagcattacctgataccaaaggttagacacacgttacaagaaaagaaaactacagataagtattctcttgaacacaggtacaaaaatgctaaatagaatttttgcaaattaaattcaatgctatttaaaaacaaaacatgatctagtgggatttatttcagggatgcaaacctgtttaaggattgaaaaatcaatggatgcctcttcagattattaaagaattatttttaaagagagaaaagtccatgtaatttaccatattaaaaaaagatgaaaaccatattaccatctcaagagatgcaggcaaagtattttaacaaaatctgagatccacttctgatttaaaaaaaaaaaactccctgcagactcctaatagaagggaacttcgtctacctgacaaacagcatctccacaaacttacagccaacaccatacagtggtgaaagactgaatgcaagatgaagccatctgttcttgtcacatcccttgacattgtactggaagttctaggtagtacagtgagtcaaggaaaaaaaggcattcaagttcaaaaggaagaggtttaactgtattttcagacagcatgattgtctatgtggagaatccagtttaatctattttaaagtgctactagaaaaaatttagtaagtttgcaggttataagatcaatatacaaaaatcaatttatgtatatacactagcaatcaacaattcgaagttgaaattaaaatagagaacatttacaataccactaaaaaaaaagaaatacttagggatacattctgacaaaaggtgggcaagatctgtacaccaaaactacaaaccattgtgaaaagaaatgaaggaagacctaaataaatgaagagatcgtccgttatcttgatttctgcttctgagatccacatggaaatacaaaggacctacagcaggcaaaacaactttgaaaaagaaaaacacagttgaaggactaatactacctgattacaagagtgactgtaaatccacagtactcaagatcggaaatagcttcaaatggacaaacagataatggaacaggaagaaagtcagggaatagacccatacatataaacacctgccctatgatgacatggagaaaatgaaaaggcaagacacagactgggaaaatattgacaaatcgtttttctgttaaaaacttgtggcaagagtatagaaagaactctcaaaaatcaatatgaaaacaaacacaagcagacaaagaaaattgggcaaaaggtttgagcagacacttcaccaaagaagtacaaatggcaaatcagcacatgaaacaatgctgaatatcattagtcaccagagaaatgcaaactgcacccacagtcttataccactgcacaccaagtagatgccagaaatgcaaactgcacccacagtcatataccactgcacaccaagtagatgcctaagaagctgctgttatcaagtgtcggcaaggccgtggaggaactggaaccctcgtatgctgctgagggcagtgcaaagtgtgcactaccactttgcaaacttatttcacagtttcttataaagattagcacacactcagcatacaatccagccattcctttcctaggtattccccaagagaaatggaagcatgtccacacaaaggcttgtacatgaatgttcctagcagctttatttataatggccaaaaactgggaatagcctaaatatacattaacaagcggatgaataagcaaactgcaatctttccatgcgatgaaatcgtactcaacaatgaaaaggcatgaactgatctcaaaatagttagattgagtgaaagaagccagtttaaagaagggtacctgctgtatggtgccattcatttaaaactctagaaaatgcaaactacagtcacagaaagaagatgagctgctgctgggggcaggtgagggtgggggcacaggggcagaagaaaatgtctgaggggccagaccccacctagactgtggcggtagcttcacaggtgtagacgtacgtccaaaatcttcaaattccgtacttcaaatttatatgtcgcttatacatcaatgaagcggctaaaaaacttctcattgtgggacagtctacaaagaactgtactgttcccttctagattttattttgtttttttattttttctgagatagagcctcactctgtcgcccaggctggagcgcagtggggcgatcttggttcactgcaacctccgcctcccgggttcaagcgattctcctgcctccgcctcccgagtagctaggactacagacgcctgccaccatgcctggctaatttttatgttttcagtggacgaggtttcccatgttggccaggctggtctcaatctcccgacctcaagtgatctgcgtgcctcagcctctaaagtgctgggattacaggcgtgagccactacacctggccccccttctagatttttaattcaagaaacacccccaaaaatgtggggggatttattctcaagactaatgtgtatcagctaagtgcagttcctagttggatcctggatcaaaaatcagaggctcacagaggacagttgtgaacaattgggaggaatttgactctggactgcgtgtcaggcagcaggattgggaggagtttgactccagactgcgtgtcaggagggaggactgtgtcgctgtcacgtgtctggagtgtgatcatggctttgtgctcatggaagcaaatgtccttttccttaggaatatttctgggcaaagcgtcatgctatctgcaactttcacacagtgcagaaaaacacaggggatcagggggcagaaagcaaacatggcagagtattttttgaaattgtccttagggtcatgtgatgggaccagagctcaagagcagcagaacttcatgatgagaaagtccaggagatgtggccacagctgtcttccgctggtcacactttgcaaggatggtggtagtggttgttttaataagttcctcaagcctgctgttagcatttgtgtatctgctaattagcaagattaaggagggggagagttaattaaggactcccgtaggcaaggttccagttaattgagggtttttcatagataaaattaatactcagtccagactgaccttctgagttatagttaataaagttgtggttatggtaccaccagggaactccaagagcgtaatgtcagtggatctggaaagatgctctgtgatggtattcatgaagtaaatccagatttggaaattcaaagaggcttcccactgggaacaggctgctgtggtccccggaaggaacccgcactatgaagaaaaggcagatgagagagtcatagaattttgtttctgcagcccccacgtctgtgctggttctcctacccgtgctcaaattctctactgttttctctgcaaagtcgtttcaccacagttcgtgtatgctggcgttgatagcctctcctcttcctgcttctccacttttccccactcccccttcctcacacacgtacacgcaaaactcaattcaaaaaatgtgcaaggttagctttctctgtcatccagcgatgactcagtctcaccaagggggcaagagagtgccatctagagcgtgtgaccctgctggtcccacagcagaaggcagtgccctggtgggggctagtctagttaggacctgagcaaacattttacttgtgtcccgaactcttgttcctatagtttctatcttaacaaattttatttttttagaacagttttagatttacagaaaactggaaaaggtagtaaatagagttctcatgtaccctacacccaattttccctgttgacatcttctattagtacaacatgtttgacacaacagtcaatgaacttatgttgatcagttattaactgcagttgatactctcatcagattttcttgctaatgtcctttttctgtcccaggatcccacatgacattgagtcctcgtgtcttcttgggcttctcttggccgtgacagtttcccagactctccttgtttttgatgaccttgacagctttcaggggtactggtcagggattttgtagactggccctctgttttgatttgcccaatttttttttcgtttgagacggagtctcactctgtcacccagtctggagtgcagtggcgcgatctcggctcactgcaacctctgcctcctgtgttcacgccattctcctgcctcagcctcccgagtagctgggattataggcgcccgccaccacgcccggctaatttttttgtattttgtttagtagagacgcagtttcaccatgttagtcaggatggtctcgatctcctgactgcgtgagccaccgctcccggccatgcccaatgtttttgtcctgattagattgggatttggagaggaagaccacagaggggagtgcccttctggtcccgtcataatgagggtgcatgctgttggaatggcagatccctggtggcgctggcctgggtccctggctgaggtggagcagacccggctgaggtcaggcgtcccccgggtgaagccgctgctgccgccccttccggaatgggctgctctttggaaggaagtcgcttggatgtgctaggcttttgttgcctaaactgctttatgtctgtggttaacttattccttcctgcagtttcattatctttttagggtctaaatatagttcttttaatttcctcttgttatttatataggcttactgtataaggcttagtcttggagttgttttattttattacattttgttttgcatttctgggattttttagtattccttctttcagtttgccccttcttgagctaaccttcctgcagtaccatcttccagctgactgtcagtggatgaggtggaaacagttttaccctttctgcagggagctttgccagttagggacccttcaggagtagtcaggaacgcgcctgtgcccacagttgggtgagtcccaggaacggcaaaaatgtcacctagcgttccccctgctcatctaacatagtttaattgccttgatggtccatggaatttccaaactagaggttgtgatatgcagaaaatcaacaagattgcattgctagggagcacgtttgtgaagctggcgtcttccacagaagctgtcatcagcgaggaggggctgttgaggggacacatttgtgaagccagcatctttcacagaagctgtcatcagcgaggaggtgccgttgaggggactccgggtgatgctttcgtcgtttggaaagtagcactgctgtgcagaatggcctctttttagccatcctcctagttccatgtggagccctcagaatgggttttactccgggcagattccaacacaccctcatgctatcccgggagaactgcggaccaggaaggcagaggccccttcctcccacccccatggaagccagaccacacgagctgggccacccagctgtcccagcactgggtcggtcctgggagaccacccaccccagaagagaccaggctaggtgacatgcacattggtgacaggccaggctgcagggaactgggtctgtcggtgccccctgggaaggtgggaggtgtttggctggagggagacagttgtatcagctgcctccgggttgccaagaatgaaatgaacaaaagagagaggaacccggagggggctgtctgcccagccatcccagttccaggctcttttcgcctgcacccaggcagactagaccgagccctggcaggggtgacggctcgccctttgcaagatggatgggcacaacggggccctggcaggtggaggtagcacggcaggctgtgccgagggcgaccacagaggctgtctctgtgtggcaacttcagggccccatgattgatggttaggctgcttggaacctgatcaaatctcagctcagcctgctgggtgtgagcaagggagaggggatggggagcctggtcagcctagagcgggccccccaccactgaggaggccccgggggggacccccagcctgacttctccctgctcatggctggctcctgtcccacactctttcgctactgtatttcctcttcttagtattagaatttggatgagaaaggcaccacagttttgacctgaggtcaaggctgggttcgttgcaggtccagaaggctgcagctcagacacctactctagccagaaatgcccggggctctgtgcggttccaagggctcctttgccagccctgccactgggcacagggagcccctccactactcaccgcagacagagcagctctccagtgggaagcaggtcctgggagtgattggcatacgtgatctggaattgtgatgtttctccacagcccaaacatgggttcttttattcattcatccaacatttactgagcgcctaataggaaccaggacgtgctgcctcctgggactaataaagactaataatgcatgtttttgtcctcacagagctgaaatctagcccggaaggtggagggtggaaatggctaactcaaatgcagcagcttgggaagtgcagtccaagtccctgcaaagggtggggagagaagcctttgcagaggctgttgcccggggacagggccccaggcggagaggacaaaggcccagcaggcagagggagctcaccacattcccaaagccgcaaaacaatgagctcggtgtgccccaaagtctgaggagctgaggagaaaggggaagatgagtttctttgtgcagagatgtttctcagtcaccactgtcacactgctgggttattgacaccagaatgtgaagaatctcactgtcagtgccacatgtgggagggcattgcttaccatgactcagcgtggcctcagggacagtgcgtcaggcccggcaggacagcactcggtctgtgctggggaagtcgtgcagacgtgcagagatacagacatgtggacccaagtcagccccggactgagcagcgggtaccccagaagggatgggcagtggaataaggattacatgtaggggcagaggacgtctcagtctgtacctgtctatagcattttaatgtttgagccttgatacctacaaattttaggacaggtttgaaaaagattgaaaaagatggaaagcatgccagtgattttgctatggacatcagatgcagcattcagggccactgtagacgtgggtatgtctggcctgagaataactaaagggctttttttttttttagacagtcttgctctgtcaccaggctggagtgcagtgacatgatctcagctcactgcaacctccacctcccgggttcaagcgattttcctgcctcagcctcccaagtaactgggaccacaggcgcgtgccaccacgcccagctaatttttgtgtttctagtagagatggggtttcaccgtgttagccaggatggtctccgtctcttaacctcatgatccacccgcctcggcctcccaaagtgctgggattagaattaaccatttacagaaaatcaatgtgtctatattaatatatatatttatgttgaaatatcttgcctcacttggcgagtggggaatacactgtgcctgggggtgaaggtctgaggcggaaagcttgtcttgcactgctcggtggatgttctgctgaagtcgtgaagagcagtgagctcttgtgaccggtaaacagaaatccctgcttcggtatcatttccccaggcattagcagttttattggcacccaccattgtgaaaacgctgcacatatcaacatctcagcacagccctccatctgcctgcagatgacttccccggtagcatcctcacgttacggtaacacaccaccgaaggctcactcaggagctgtgttcttgttggaaacttttttccttcccagcaccccgctcataacaagggctaaactcttctacccagtggacatgaaacacggcccgtatctctgtgattgtctctgtgttcacgtcagaacgcacgtggtagggtatttgcgtgaaatcgcgcgtggtagggtgttcgcgtgaaatggctcagggcttggctcatcatcctgcctccttatgccttccccgtcaggcacggtggtctgttagcctgggcgtaattcttgtgttcctgcttctccataaaataatccttaaaatctttgttaaggagaataaagggagggtctcttcccatggcatcttttgccagaatattcagaggaagaaagcccgccccggccttacgggtgcaccttgtagaaggcagggccttggccaggggctcctcctggtctctgccccattgtcgtgtctgcttgcaaaccacatctttagttgctgcaacaacaaatacatgcttgcatcttcccactttgtgtttgctcttcttctcttcttcacctcccttttccccatttaaaaaaatataagttcctgaaacctgagacacagaagaatcaaaattggcttcagtgtgtggtgagggaagggggcttgctcaggaaaaaaaatgtcatgttcatgctcttcccacctgctttctactctggccttcacatgtcaccaccatagcttgatctgggagaaaacaagcacagcaagatggagcctgttgagagggcggctttggcagattcacgctgccggcaccgtgctgttcatctgagccccgagtctctgccgggtcttccaccaagcccctccgcccaggatgtgtgtgtcgcctgccgggtcttccaccgagcccgtgccacgcagggtgtgtgtgtcgcctgccgggtcttcacaccgagcctgtgccacgcagggtgtgtgtgtcgcctgccgggtcttcccaccgagcccgtgccgcccaggatgtgtgtgtcacctgctgggtcttcacaccgagcccgtgccacgcagggtgtgtgtgtcacctgccaggtcttccaccgagcccgtgccgcccaggatgtgtgtgtcacctgctgggtcttcacaccgagcccatgccacgcagggtgtgtgtgtcacctgccaggtcttccaccgagcccgtgccgcccaggatgtgtgtgtcacctgctgggtcttcacaccgagcccgtgccacgcagggtgtgtgtgtcacctgccgggtcttccaccgagcccgtgctgcccaggatgtgtgtgtcacctgccgggtcttccaccgagcccgtgccacgcagggtgtgtgtgtcgcctgccgtgtcttcccaccgaacccgtgccacgcagggtgtgtgtgtcgcctgccgggtcttccaccgagcccgtgccacgcagggtgtgtgtgtcgcctgccgggtcttcacaccgagcccgtgccacgcagggtgtgtgtgtcgcctgccgggtcttccaccgagcccgtgccacgcagggtgtgtgtgtcgcctgccgtgtcttcccaccgagcccgtgccacgcagggtgtgtgtgtcgcctgccgtgtcttcccaccgagcccgtgccacgcagggtgtgtgtgtcgcctgccgtgtcttcccaccgagcccgtgccacgcagggtgtgtgtgtcgcctgccgtgtcttcccaccgagcctgtgccacgcagggtgtgtgtgtcgcctgccgggtcttccaccaagcccctccgcccaggatgtgtgtgtcgcctgctgggtcttcacaccgagcccgtgccacgcagggtgtgtgtgtcgcctgccgggtcttccaccaagcccctccacccaggatgtgtgtgtcgcctgccgggtcttccaccgagcccgtgccacgcagggtgtgtgtgtcgcctgccgggtcttccaccgagcccgtgccacacagggtgtgtgtgtcgcctgccgggtcttccaccgagcccgtgccacacagggtgtgtgtgtcgcctgctgggttttccaccgagcctgtgccatgcagggtgtgtgtgtcgcctgccgggtcttcccaccgagcccgtgccactcagggtgtgtgtgtcgcctgccgggtcttccaccgagcccgtgccatgcagggtgtgtgtgtcgcctgctgggtcttcccaccgagcccgtgccgcccaggatgtgtgtgtgtcgcctgctgggtcttcccactgagcccgtgccacgcagggagtgtgtgttgcctgctggctgccgttctgcgcgtgtgtggtttcaagtcttgtttcctcttctgtttaacgaggcccttggtctaagtgtgcttgtaatttgggcgagtgagcagcagccgagagagtccaccccagtccccctagccagcgaagtgggagctcccaggttcctgcctgcggggagggtgggggcggtttgagttagtgaaaatgtgtgtattaaacagatatgtaaatgacccctgccgagcgctgaaaatgaaggtatgaaaaggcatcatcatccgtggttcccacctggcataatgaccgtatcagaacagacatctggtagtatacaccacatagttgccagactccgataccaagggcacatctaagttctcccaccctgatttgcatgcctcaaattcagaattagtgagatttgagtcagtgatgcttcattacactctcgtgagacatgtttgaggagcttcaccgtgaatgtgtgggcttcgatttgacttgtggaacctgtggttaaaacaaaggaaggtgccttcattctcagaacccagtgctttttctgttgccctggccctctgggctgagtctttacgtggacggcggtcgatgcatctcagtttatttgtcaaaaccttcagctaaagccagttgttgcttgaaaactgcctgcttaattggcctcctcagctcgggggagcagcttgcaatctgaggccggcgcctggctccctgaccacccgctccccatcgtgctcagctctcattccagcagcccagcccataacccgcctcatcagtgtattgatgtgaggcagaaacacctcattgtaagagcacccctgagaaatggcggggttaggggcttctgggctgcataaccagcagattccctctgcaaaactgctcctgcctcagtgggaaagggccagctgtgcagggctgcactggagagccgttctcttcttgatcctcaggcatccagttcttaaaattccggccctctgtccttgcatggccttcgtcctctggaaaggagcatgctgggagctggcagaacgcacgcctcactctgtcgatgcagtgtctgtcactgctcagtttctaggtattgatcctagaaacccatgctctgtgggtccctctccaagaaacacagcatccatgatttgtacatcgcactgcagtttcagactgctttcacatgcgtggtttcatctctgactccacgacctgagcacagattttttttttttgagacgtagtcttgctctgtcgcccaggctggaatgcagtggtgcgatctcagctcactacagcctccgcctcccaggttccagcgattctcctgcctcagcctcccgagtagctgggactacaggcacgcaccaccacaccctgctaatttttgtattttttagtagagacaggatttcaccatattggccaggctggtctcgaactcctgaccttgtgacccgcctgtctcagcctcccaaagtgctgggattataggcatgagccaccacgcccagctgagcacagatttttaaaactttacctgggtccctgactagtaagagggagaacctggacttgaaacttagttttgtttcaaatcttgccccttttcctcgggttttgggcaaatacttcccgaagtattatcgttacccctgaatatccaaggcaggatcattttattcccttccagagccagcacttgcagaagtgtccccaagttaggcagcctggtgtggcttccggtaacactgccagcctcagagccggcctgtttcctccaggacgcccacaggaccctcggaagccccttcctctaggggcccgtccctcctccttccccaggccccgtcccccgccttgccctctgaaagtggtcttcagcaccacccgataagcggtgacttctcatcttagaagcctggcttgggtcaggttctgcgtttcggctgtgcgcgccccggagcagccctgcttgtgtctcatcatcgatgcctcagctgcagtgtgccccactgtaacccctccgggatgaaaacgcaacccacctcttcagtgggcagccctccacttggatcctcgcatccctggcatcatctccgtcctctgtccttgctgacccagctccaacccagcctgtctgacccgtagcccacctgccatgtccttcccggctgcagctcctgctgggctctgcagcccctcctgcccaacgccacctgcccccgcctgccctgctcctgcttgcccttcccctgcccctgcccccgcctgccctgcccccacctgccctgcccctttctcctcccactcccacatcccgggcctggacctgccatttcctagcagcaggagtcttttccctcgatcccacccttccccttcttccctcactgccctggacagttctgtctgctcatcagcgtaaagaggtctccaaaaagtacaagaccctccctctccccgctttccaagcaccctatggtgcctctcgctgctccttcaggaactgtgagcagggcacaaatacctagtgctcagcacccagtaggccctcacgactgtgccgagccatggccgtgtggctgtgattgtgctgacagcacacagtaggtcctcacgactgaggcgagtcatggccacgtgactgtgaatgtgtagacaggcacagaatggcctgaagcgtgggaaggtcgcctgcctggcagcagctttagcaccaggaaacctcccaccttggggctgcccctgagggtgaacaagtggggccagtgggaagcacctgctcaagtgggactgtgcacacaaatcactgggaattactgcctcacacacgattggttttcagcattttgtaagtccaagcaaacccccaagaaaagcttgagcgggaccgggtctgcaccaacaggctggttctgagtgagtgctggatggatgtgctccagtgtggagggcagagggagggagcgggacccctggagaggagcggggtgcaggcaggggctgcagggcactccccagcaggtgcccggacgttgtgaaagaaaacgtctgggagctgctttcctctgggcgttcgtgggatccctccccttcttagccaaggaaagcatgtctgcaggcaccggctgcagctgtttttcaaatgaaaactgggcttgaaaggaggaaataattgaggtataagaagtccctgcccttattcgttcacgcaccatgagaagcttgtggcatctgcgggacactgcactcactgcctctcctctgtctctttctgtccagtcgtgccaagcggacctcgtgaaggacaacggccacaagtacttcctgtcggtcctggcggacccctacatgccagtaaggacggggcagcacgctctccacgggcttgggactcagcactcgcctctgcccacacgctgcactgcggtggggccttttgacgggggctacaggagaaaggtcaagggtcacagcaggggccacgtccacggggtcagcaactgcttcacgttagacatggccctttgcttactaccatgagcgcagctgttatttcgtgtctgtctctaaacaagagctcagttaacccggacacatgggtggttttagtttattttagtctcttttcactgggacttctttgcaaaatagtcaaatccactctccctgctgtccgccgcgttagactagtgagcgccgcacgtctgtaatatgagagttcaggcgcctgggaaggtcttggagcacaagaagatatcgaagcaccccatttcaggaaggaagggagagaggaaaggaaggaaagaaggttgtttgaaagtttaaattttcagtatactttattgtattaaattgtttgaaaattagtaatccatgaatagggtgtatagttattctataaatgtttcataatgttttaatttctaactcccagcttagtaatgagaacaaaatagatatatcctaaataattctttaacataacttaatattgccagaatatttaaacatattagctagtttacacagtgttcggtggctttgctgtataaaggaacttttgtatgtaatttcaccccctagttggttttctaagctaaaggattttttaaaacacaaaacaaacaggactattttccaaaaggtaaacagtatgtgcactttgtgttgtattgaaacatcacaggcagttaaagttgatactttgtatcagttttggaaaccatcacttcccattcttaagaataaggaagaaagcaaatcccacatgaagaagtgaggaagaatgctcactggcgacttgggcgcgagggtgagctaagctcacatgaacggccccacctcagccacgagcctgcggaagttttgaggacacagccaggtttgaaagaatgaaaaggaggctgggtatggtggctcacacctgtaatcccagcgctttgggaggccaaggctgacagactgcttgagctcgggagttcgagaccagcctgggcgacatggtgaaaccccgtttctaccaaaaatacaaaaaaatttgtctggcgttgtggcacacgcctgtggtctcagctactcaggaggctgcagtgggaggatcgcctgagcccggggaagtcaaggctgcaatgagctgtgactgtacaactgcactccagcctgagcaacagagtgagaccccgtctccactcaataaataaataatataaatattcttaaatgactgactagaaagaatttgctatgattctgtcaaaccatcaaccattgttttgtttcttcagtgctttgtgcctgttatgagaaaacattcagtgcttcctactcatcctcagaaacgattgatttttctaaactcataagcagatctgaaaaaacaaattgaagctgtgaaaaagaaaagacatgcactgttattgaaaactctggagatgaattaaatcacagaacagacagccaagaagagaattcatgaaggagccacctggagcgccgtccatgaagctaagcgagaagatatgaaagccgggctaagagccgggctgggaacgttcaccatgtagccagcatggttcagaatgagaggagaataagtagagaagcagtttttgattagatagtggctgagaattttccagatttgaagaaaggagagttccgattttaaaagcaggatgaatcctgagaaggttaaagagaaacaaattcgtacatagacgcatcataatgaaaacagcaaatatcgaaggcataaagacaaaccttaaaagtccccagaacaaacgttattagcaaaggaggagacagcaccggccccaacagcagacctctcatcagcagcggctctcggccggggacaggggagccctcggcgtgcgaggaaagcgaccacggtcgggtcacctgcacccagctcagtcaccactcaggaatgggggtgtagtaagcagcgttcagacaccaacagtttactccttccgaaccccacagaccatggctagaaagaccacatgtcagcgaggaggaaacggaaccaggaggggaaagcaagatgcaggacacggcaaaaagccaagaagttggcacacgtgttggcacatctatagatttgtaaaaatgaagaatactcatggcgaattggagggttaaacaagaggaggactcaggtaccctgggagccctgcaataatccaaggagccctgcaataatccaagaggcgcgtaggacactagaccgcgcgacgtgtgtgtaaaaaactaaggcaccgctaaaaagttacaaatagactctggtttccaggtcagcggaggcacagaggaaaggacagaatgaaaatgagtcacagtagagcagaaaggagaaaccagtgaaacctagagcgctgcctccatgccttttgctgccaaagcccctgattgcaggaccgtgtgctcacagagtgctgggcaggctggggaggtgaggtccgggtgcttcataccgacagccacggctggcctgtgacagaggaggcatccaccaggtctgtgcccgtcttgcagtgttagggcttccaaggagcagtctgttcactccgggaggcgagcctggagctctaaggcctttgaaaacagctgttcttttttgtagagtccacgtaaaatccaggagtaaagctggctctcgttactttaattatgcgccacgcgtgtcatgaagattccgaaaggatcacgctgttgtactttgggaatgagagtttccactgaggggagacgaccaggactggtttttgttttccaggctgaacaccggaccatgacggctttcattctcgccgtgatcgtcaacagctatcacacggggcaggtgagccccccagccacccccagccccagagctcacccttggcattgcagaggagctgggcccactgtgaaacgtggtgccacatgggggacagggggtgtccagcagaggctctgacccttcatctagccagccatttgcaggctgaatatgaatcagaggaatctaaaatggggaaaattgagcaaatcaaggcttcccaagaatgggtggccaccgttgtcccgtgcaggtacccaccacgtgcctgccattggcaggcagaggccaacctgtctgtggtcccgcctctgcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtgagtcaggcgggggctcagagtccagtcctcctggctgccgactgcgggggtaaggcagaggtctgctcgcgtgcgggtgtggccggccacgtgtccaggaacttcaggggctgcacgctaataagagtaggacagtgggaccttggtgagaagagaaccacaccactggggattttgcacccaggcccagagtgcgctcccggggacagtggcacagctgcaagcgggggtcccagagggaacctcagaggcaggggtcacgtgctcgctgtccgggtgccgctctgcgtcctcactgtggcctgcaaggcagggaccactagatctccactttacgggcaaggagtcaggccagtggctcgtgcctggtgcagctgggaaaggtgcggggcactgcccacagagtggccgcgggctggaactctgggagtttcatgcaccattgccttcactcttcccaccggcctgtgcagtgcacagggtgttgctcatttttagagctgaggaagcagactcagggacagtgacttctccccaggaccacatggtgtcagaggcaagggctaagccagggtccccggaccccagggccagcacagtgtcgctcccctggctgagccctgtgtgctcagtgcacttcagggcccccatgcccctctgcgtccaggagtgcctgcgccctcccctctttccaccctcccacgctctgtggcccatcccagccccctcgtctaactcctgcctcgttcatcagcacattccctggtgcctggtttggtgtttcagttcccggggcaatgcagctcccgcctctgcagtctgagctgcccctggagctgggcggctgcccctgctgctccccacctccttccccgttgccactctgatagtgcgaggagagccttgggcctggagagctgttgagcaagcgcctgtggggttggattcacctgcacacacagccctggcagaaaggcaggctgcagcatggcccggtgtgggacatgcctgtgaccccccgccgccttgcaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggtgcgtgaacccccagcccggcagcagcagggcacccaggctggaccccgtgacacctggggccaagcccgcatggccctgaccacagcagggagcactcagtttccactgcgtgtcattgcgagagcagatctttacatgtttcattctcttcaagttgcgtttctttaccagacacccatgggtttgcttcatttaaaggcatctagcaggctgcgcctcccggcagcttgtgtagtagtctccttcctgcctgggagcaacacacacaggcaccactgcgattccaaagagacgcagccacccacagatggcgggaaggtttgtgtgctgggtcccccccaacaccccatgtacgtcagcgactgaacaaaacagttttatgttttgttttgttttgtttttgtttttttgagatggagtctctctctgttgcccaggctggagtgcagtggcgtgatcttggctcactgcaagctccgcctcccgggttcatgccatctcctcctcagcctcccgagtaactgggactacaggtgcccgccaccacactcggctaattttttgtatttttagtagagatggggtttcactgtgttagccaggatggtctcgatctcctgacatcgtgatccacccacctcagtctcccaaagtgctgagattacaggcgtgagccaccgcgcccggccaaaacagttttataaacttgaaaacttacttacctgtttagatgtagaaatatcacagatgatcgtccaaggtttcacaccctcagattccccacccaccccagcgcaaaaggggcgtttaggaagacactggtttcctgatctcctttgctggtgagatggaaggctgctcttgcagagaactcatctgacagctggagcacagagctgctctatgggcagggagtgtgtctccccgtcaggtggcgttggccaccctcgtgcgttcccgtgctggctgtgtgtggctccctcttggagatgggctttatcatgagacgggccgtggtccaggggcctgggggttgtttgtctggagagcagctgccgctgctttacttgggagggacgtgacccggacaggtttccctcagccagacgaagtgtggaaagtcacgttctatcgtgtgtacccttctagaattagcccaagtcatgagtatgctacattttctaacgaaatcttgaaaataggaagtgaggttccgggctgccttttctgttggttctgactttgttgccatcacgttctcctcgtggccgggtttctgaacctggcttcttttggcccctgctgaattctttttcccacatcaactcacgtttggtggacatcactgatcaaagcagcaaatcagcggtttgtctgctaaaattctttttaaagtaaggaaagctttgtttcttctttacaaaaacgatatgaaaatagagaggacgttagctgtgaggcgttccccaagagccatcccgtggccgggctgtggccctgtggtgtggccctggctgctgaggcactgagacgaagctccccctccaccgggagcggtccggcgtcactcgcctgcacggctgcctgctgaacctgcatcctggagatgtggcccgcgaggacaccgtggggttcggaggaggtgctgccaaccgggacgcagctgtctcggggatgctgggcagggcgtgtagagggggatgacagcccctgccctccgggagcacgtggtctaatcaaagaggcagatacagataaggtcattacaccagagccttgtggagaaatactgcctggagtgctgtggagctcctgagggctgtgcctgtgcctgcatcggagcgggaagggtgtcagcagaggcttttgtggaggggcagctcttacctggttatggagggtgagcaggagaagcagccaacagagctgataacgccagctggcagggtgatgtctggagggaggaaggctagcgaggagtcagagaaagacaccgtcactcacctgtgaccaagcgggctgcactggcgcgcagactccggaggtgcgctggctctgaggggctgtgctgactctggggggtgccagctcggggggtgcgctggctctgagggggtgtgctgactctgaggggtgccacctcggggggtgcgctggctctgagggggtgtgctgactctggggggtgccagctcggggggtgtaccgactccgggggtgtgctgactcttggggggggtgctgactccaggggtgcgcctccatcctcgtcatagagtcctgccgcatcacagctggttttctcttctgtttactaaccaccatgggcaggcacggtgctctgcaggggacttgggcacaggtgcaagcaccaaggagcctggcggcgtggagccggccccattctcgcagcctcttctcaaggaccatcctgagcccgtcctgagcctgctgtggggctggggttggggagtagaactggctgagaggctcctggcaccctctggggtgggagagaggagggtgttactgctgcttttccataaaagcaacgtgtactggttaccaaaaaggttacatccatcctactttttaataataaaagtgtcctctcctgtgtggggtgataacgatggccgagtaggttttgtttgttgacttgtttaatgagcttacttgacaaaatttaaaagtcagcaaattcagcttagcccccaaattattttgaacttcaacctgtctttgaagtacaaaacctgcagtcagcagccacccgtcccttgtcaagaagggccaggccaggggtgcggggctagaacccccagtgtcaccccagcctctgcctgggccgggctgggcaggagccgcacacagggacgggctcagcggggcttggatgggggcttactccctccctgtcatggcctcgggaggaaataaggactgttcagatactattttattttatttgttttattttattttgaaacagagtctctgtcacccagattggaatacagtggcacaatctcggctcactgcaacctctgcctcccgggctcaagcgatcctcccacctcagcctcctgagtagctgggaccacaggcgcgtgccaccatgctgggctaatttttgtattttttgtagagatggggtctcgctgtgttgccccaggctggcctcaaattcctgggctcaagtgatccactctgtaatcccaggccttggtctcccaagatgcttcccaggacgctgctcgggcctgctgtggtcacaggagctgagttttatgatgcctgagcacaggtcacaagacaaatattagccagtgctgtgttgttggagcggagtgggtggccctcagggcaggtgggcaaggggtagaggcgaggtgggccagtagcccatggtcagtgcagccgtgtcaacactgggaagtgtgtgggcccccagcggggcaggacatgtgtccaagaaagatgtccttgagtcctggcaccagttcacggttagaaactaaccatgtgctacagacgacacccctgcagggagggctgcacccacccagaacacacttgtcaggcacgtgccacgtgccgggccggctggggcctcagtgaccccgcagggcactaaccctgcctcttctctcaagaaagttacccctggagctgggggaggggctgggtgtgagagtggtgggccggggtggcagctgagcagagccagtatggatggggctgggggcacagggaggccttgccacagggagaggcccagtgcaggggctgtgcccatcagagggcgtgggcacaagaggccaggagggcagtggggcaggtggcccagccaggcacaagccttgtcgttcgtgatcagaggcctggaggggtttgggggcaggacctcaccttcggctgcccaggtgagaggggccgctcgcccagctgcagggacggcgcaggagggaagaggcaccagcactttgaatgcggagctcacagcacttgctcacaggtggagagggtacgagaaaagaagaggacagggaatcctgggggtttgggtctgagcaacagaagagcagagttgcccctcgttgaaggggccagccatgaaggagcaggttccaggatcacgcatggactctgaaggtggggagccgacaggaagggctgagctgacaggtgaaagtatgagtccaggcaaagctgcctccctttcgaggaaggctgctcagccccagccagggagcaggaggacagacaatggctttgacaagcgaccggtcagaggacctgggaagcctggccagtgtggagcccgtggccactaatgtggcctccccgtctgtgtgctgctggggagccctcagggggaaggggtcacatgacaacaccagccaagctcatcttgcaaaagctgagagagaggggagctcccacacccctggctgagcacctctgccagaccctctgatgggttctgcatgaatatcctaaagaaggccagtgcgtgtgtgtgttgctgtcagagcccagctccattcaggaagggcaggaagggtccaacgcaaaggagagctctttgctgtgtgccaggcagcagcctccagagcgaggcccgccatctccagcaggatgtgcggcctccaagggaggcccccgtacgcagcaggatgtgcggcctccgagggaggcccccgtatgcagcaggatgtgcggcctccgagggaggcccccgtacgcagcaggatgtgcggcctccgagggaggcccccgtacgcagcaggatgtgcggcctccgagggaggcccccgtacacagcaggatgtgcggcctccgagggaggcccccgtacgcagcaggatgtgtgttcgggagtgagggaggcccctgtatgcagcaggatgtgtgttcaggagtgagggatgtgcggcccccgagggaggccccgtgcgcagcaggatgtgtgttcgggagtgagtgctctctggacattccccttgaataacagacgtggcccctgttggcctcccctgaatcgaagggcccaccacctcggtgcacgttaatccatgccagctcccagctctggcttttctcacctgatgtcagaaggaaagggaaaaaaatcggtgctttctgaagacaggtgcagccttgatcttccctggaaggggcccagtgggtgttcgctttgtcggaggccccgtctcggcagtgcctcactcctcttgcacagggaaggcagcgggggttctgtggtttgccaggggagcctgggacagtgacttaggcagttggagacgagcgccagaaccggggcgtgggccatggccgtgaagacgcacactgggccatggcccttggtgcccagcagggtgggaggggcgggtggagggtgatgccagggctccattctgagcagtgagagacttgcagttccatcggcgcaaatcaagagggcgctgcaggctgaagggaaagtagacggtgcccgcagttcatagggcagggagagtttggggtgcaggtgaagagccggcagctggacagccagcctggacctaggagagtgaggggccggcatcagggaaaccacaaagcatgataggaggaagcccggggcatgtaaggctggggtgggaaagtgcgtgtacagagagtgcgtagacggagagtggggtggccacgagaagaccctggtccctggtgggcgcccatccagagcctgctcatccagccgctgtggagacaggggcgtcacgcgactagcaaggggtcctctcacagcgcttggctttctgctaagaatccgtattttttcttttcagaaaaaaaaaaggcagaaaaagttgtcgtagggaaaaaaacgttctttccgctttttaaacctacatcccccttctgttccccagtgacttctaggatctccagctgttcctgtcacagcactgaactgtcctaaaagagaggcaaattgtgtctgttcccttggaccaaggcatttggtcctaaagatgatgttttagttctacaacttttcccgttccctcttagggactagaaacatctaccaatgaaagtttcacatgtgttgaaaagagcaggcttcggcttgtccgctgcactcggccctggggcgctcagattcagaaaggccgccagccatcgggtgtgatctagagcggcgttttcagccagggtcccagtggtcaccgtaagcgagaggctgtgaggcctcctacctttccctctctggagtcctgtgactcaccgtgtccttacgagacccccgatgcgtcgtgcgcctctagcagtggggaggattctggcaggcattctgggcttcccccgtgagccagtggcctgccgtctcccagcactctgctattccaaggcctctgctctgacggttcgaaaagggatggtccctgtttctgatgccaattgcacggttttgtcttaacctttcttttttctgttggtgactcaagtctcactgctgctccacaatcattttccagccccagtgactgttattgtcccttctccctctcggcaggagctggtggtggctctgagtcatcttgtggttcagtatgaaagcaatttctgcaccgtggccctgcagttcatagaagaggaaaagaactacgccttgccttctccagcaaccacaggtatggcgtcttctcctgtgaacccgcagagcacctcgcctggcggttctagtgcaggccgcggcccagtcttgctcaccctcgcagagtctaagcgcaggtttctcagatacctgccgcaaggggtccctgtttttctcatctttttaggcacctgccagatttaaaagggcaggaaagagggccacactgaccctcttacatttttcctttctttttaccctttttggaaattaaactcacagagaccttgaagtatgacaaaacttctgcagtaggagcttgcggaaaagcgcaggggccgtcttcctgcgatgagtaatttcatcacactgctcttggctccgtggctcggtgagtcatgtcaggcgtgctttctcacacgtgtcgttttgactggagagtacagttcctatctcatcgctgccggcagcccctcccgcttccacacagccgtctctgccgtgcaggggcttgtcatcagcagtgaggcctcactgcttctaggaagcccaggaggggagaagggtgagccagactgagtgtggacggtcattgctctgctgcggcttcccggggagcacggctcacggcccacgtcaccatgcacctcgtgtgcactcggacaggccgcagccaccagcctctcccctgttgtcttttgtaatttaatatgcacagagccacaagcggttgttgtttgtccagtgctatcccgcagagcctccgctcacgtctgagtctccctgagctgtgcagcccctgctctgacatttgttgcagcacaggtagcagctgccgtcaccgagtgtcccagctgctgagtgtcagaagacacgctggcctccacctggaagcccattgtaatttgtctttctccttctttcccagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatgtaagatcctggaaatcgggttattggattgggagagattggggttgttttttctgaaacactgtatctgagtaagcaccactctgcccctgccccttcgtctaagtgcgtgccctgaagtcccatctgccaacatggtgatgagtcacccttccagacgtgagcatggcaaggaggcgtaggccagcccccagaatagccagcgggcccgttaccaatgcggcagggagctcaagcgcagccgcagttgaggcggtggctccttggagggctgtgccctgcccccgtctcccagtaacctgtggtctgcgggtggggagcttggctcccagggagatcagtgagtgcctgtgcctgtgtgtgcgccggggcgtgtgtgccagggtgtgtgcgccagggtgcgtgtgtaccagggtgtgtgtgcgccgggtgtgtgtgtgcgccaggtgtgtgcgcgcgccaggtgtgtgtgcgccagggtgtgtgtgtgctgggtgtgtgtgcacaagggtgtgtgcatgccagggtgtgtgtgtgtgtgtacaagggtgtgtgtgtgccagggtgtgtgtactgggtgtgtatacgcgccaggttgtgtctgtacgcgccagggtgtgtgcgccagggtgtgtgtgtatgagggtgtgtgtatgtcgggtgtgtgtacatgccagggtgtgtgcgcaccagggtgtgtgtgtaccagggtgtgtttgtgcctgggtgtgctgagctttatttagaagaaaatatgtatctcagtcatgccattaactgtaagaccaaaaggagggtcccgggagcaccccactgaccccgttgcgtctcgggcagctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggtgagtccgcctgcccctttctgcttccgaggggccccgagggtctcctccccacacagagcagcacagacctgtgtctgcatcaggtcagtgggtgtcaaaactgtctgttcaaaagaaagaataaaggtcaacaggactgcgaggcagggagaacgttttgctggggcaagcgggaaagttgacatcactgttgtgttggggtagtattttacaggctgctccggagccatcggagctggccagtttggctgggtgggaaggctgccagaaccttccatctttgttccatagacgggtgagagttcttcatggtgctggacaccctggtgatgcagaacggtggttctcagccgggggtggttttgccccccacgagcaactggggtacagtaggggtgctccttgtcccagtgggtgaggccaggaagctgctcacatcccctggtgcccaggacagcccccacacagtgtccgcagtgagaggcggagggccctgcggtcgggctgggggctgtcatccccgccctgctcacctgcggaatctccacacaactttccctccatcccagcagcttgacgcagcactgcctggaaatggaaatctgacggaagggtcagattcttctcttgttctgccatgaatggtgtgtgcctgggtcctaccaccaggattgctgttgtaaaacaggagaagcaggaattcaccgtgttttcttattgtgtagctatgttcatcttcacactgctggtaacagatttagggcttaaccaaatgagcctcatctcctcttgttctgactatccagagtggcttaccggcttcatttgaatttttttcatgttaaggagcattttagccatgtaaaaatttacagagacttatataagagcgctgcgtgtgtgtgtgtgtgtgttgtgttcccagcttaaggaattacagaggtcgagccccagaccctaccccggtcccattccctctggtgacattacactttccctccctggccatgagccctggcacacacgtggtgcccacttagaggcctttacctcctattggcgccgtcgcacgatgcgtggcccgcaaagcccgtttctttggctctgacttcaatatgtatctttgatggtcatctaggttttgttccttcacctccgcgatctgccgtgactccattatccattctcctgtctggggacagtgaggccggttctagtttcttcttgccttttgttccttttcttaataagcaaactcagaattcagcccctgccaccatggagccccacatccaacacaccctcactcgctgcacccagctctgctgggccccagcctacccggcccccagcctgggcatcggtggggaagctcttctccggcatatggtggccgctcccctctcattcagagcccccatctggcagcaccttcccagaagcctccccagccccacgccccacctggaatcaggcttccccagctgccctctgaccctgctcccttttcctgctttatttttctcctgaggactgtggactgcagacgtgctgtacgtgtaacttgttcattggcccggcccatctctctcccctggagcttgagagccgcacgtgcaggaacccagccttgttaaccactgtctcctcccaccctgtccacacccagtgcctggtacgcagtaggtgctcaatacacataaacgggcacgtgtgtggtgcgtgttcttcagcgtggatacacgtgagtgcctctcgccaccttgcctcagagtgaagctgctgcgtgaacggtgcctgcaccttcagcttttgtagatgtcgccccaggccttccacgggatcctctgttctaaagcgcaggcgcccccatctcgccactctctaccacgccggtcttggccagcctttgtctgtctgatagacacacctggtgtctccttgtggcatgaatttgcatctgccttgattgcagtgaggttacagccttgcagccttacagactcgccttgtgtcgtttatctttctctgagtagtttgtaatcagcattcatcacagttctgggtgctgattcctggctgaatatatccatcgaaaatgcatctaatctatgactttttatgatgcctttggtgccacacaagcttaatcttttagtttctctttttctttataacttgggccttttgtgtcttgtttttcctattctcaatgtcctaaacatattctcctacattttcttccaagatttaaaattttccttttttgtgttcatgtcttaagtatatcctgaaccacattttgtctctgtggtgaggtggggatccaggttgtattttttctttatgccaccccagacccttcatcagacagcccgtcctcccgccagtgcttctcagcgtctccctggccatcagtccttagggtctgagtgggggctccattcttagcagcacccatcccatccacggccgcgccgacaccccacacagccgccccgacaccccacgcggcctcgctgacaccccacggccgcagcaacaccccacacggcctcgccaacaccccacggccatgccgacaccccacacggccgcaccgacacatcccacggccgcaccgacacaccccacggccgcaccgacaccccgcatagccaccccggcaccccacggccgcgccgacaccccacacagccgcgccgacaccccacacggccgcgccgtcacaccacagctgcgggggcagcacctttgagcccgctcctcagttcgtttctcagaactgtcttggccgctcttagccctttgctctgctgtatacatttcacagtcaggctttctgtgtcgacagcagcctcactggggtgttgtttgaatggcgctgaattggtggatttccctgggatgactgacttccttgcatcatgagtcttcctgctcctgaacagggtgtatctttccatttacttaagtcttctttatgtcttcaagacagtctaactttctgcataaaggtcacaggcatgacgttacctttcagtttttgtaattttaagtaatatcttttttaaaacctgttgctggcaaaaaaagaaagaatgccagtgggctgggcacggtccctcacgcctgtaatcccagcactttgggaggcggaggccgagacgggcggatcacgaggtcaggagatcaagaccatcccggccaacatggtgaaaccctgtctctactataaaaaaattagccaggtgtggtggtgcgcacctgtagtcccagctactggaggagaatcacttgaaccggggaggcggaggttgcagtgagcggagatcacaccactgcactccagcctggcaacagagcaagactccatctcaaaaaaaaaaaaaagaatggcagtggacatctgtgtttctctcttgagagtaaacgaaacctttctaaccttttacctttgatacgacatttgctgtagattttttgagtgggtgctctatatcagtttatagaaattcccttccctttggttcactctttttatgagtgcaaattcccattctattctagttagttaagaattttcctgataaatggaattaatttctttgaatgtattttctgcatctcagaatgaccctgtgcatggctgtttgttagggtagggaattacatgattgaatttcttgtgaaatatccttgcatttctgggggcacccagcgtggtaatgtcccctgacatcgctgccttacgctcaccagctatttctttgggcgctccccattggcattcacgagtgggttgggctgtgacttttcttgtcctgacctggctggtttagacattgagtctgtacctgcctagtaaaactggctcctccgggcatggtgacaggtgcctgtaatcccagctacttgggaggctgaggcaggagagttgcttgaattcgggcagcagaggttgcagtgagccaagatcacgccactgcactccagcctgggtaatagagtgagactccatctcaaaacaaaaacaaaacaaaacaaaacaaaactggctcaggagtgtaccctcattccctgtccaaaaaaactggctcaggagtgcgccgtcattccctgtcctcgggggcaatttttataagacaaagatgatgtgttctttcggtgtctgagtagaatttgcccctgaactgtctgggctagtgtagtgttgtgagggtgggtttgaattctgtattccatttctttaatgctgataggattatttacattctctatttcttcataagctagcttcaaaaagttttattcttctaggattttattcatttcagctaagtattctcattctttcccttgaggctgtctgcagtattctcatgagtctctaatctctgctgtctctttattgttttagctgcttttactgatattcccaatctgctgcctctttagatatgtccccgtttattcctattgttgtttatttgccttttcccctttttcctgattaatcctctaagatgtttgttcatttctttagtgtcttcaagttctaacttttaggctttgtggatttactgcattattttatctttatttttctattccagtactttattttgtttcctttctactgttttctctaggttcactctcttgtcctgttacagttctcaaacagaaaataaaaacagctcattaactttgagtttttcttccttcctaatgtgtgtgttcaggtctgcgggacccctgccccggctcccccaacccctgcccccgctccccccccgctccccccaccccccgccgccccgactccccccgccccggctccccccgcacctgctcacccaacccctgctcaccccgcccctgctcaccccgccgtctccgtctagtgagttttgatgatgggcttttcacttgtgttcagcttcaagctttctttctacttccattgtggttcctggggatggcggtccagccacaatgacagcagcgcatgacaggagcccaaagacccgaaacagacgcagggcatccgccaaggcagttcccaccgggcaaccctgtgggtgtgctcccagccttggccagctgctgccttgagcacctctggatagaacgagtccagagcttgcaccatgccctccagggtatggagaactgaaaggttcactacacaacaacccagacacgccagcttagcccagacacgccaacttgttaattttcattgagaaataacgttgcagctttgtgcatttggctgtccactaaaatatgccaagtgcccagaaagcgcagagttgactccgtatattcgagtataaatcaaggtattgccaagtcaccaatgaaatatattctaacgtcacttgtaagatgtttgttttgaactggaatacactttttaaatagaattaatgttacatatagtggttaggtttccaggctagcctgcaagagtcttttaaaacctgtctgcagaaattctacttataaatctacaatgaaaaaaggtatttaaaaatttttttttaagtactagaaaatgtaaattcatagtattctgttttgattacacatttcccctggccccggccacagctcctgtgaatagctctctagcgcctccagcaggttagtgccacctctgccccagttcacgctcatcaaggtcaaggtgatagctcccttccgtcacgtgtaggttagagcaggagtctgcaaactcttcctgtgaaagagctttgcaggtgggactgccccttggcacttccccaacactgccagtgtggtgcaaaagtagccagagaccgcgtgtaggtgaatgaacttggccatgttgctatgtaaccgtgtggactgaagtttgaattttgcgtaacttcacatcacaaaatattgttcctttgatttttttttcaaccacttaaaaagtataagaaccatacacaggccatagaaaaacaaggctgagttcagctcagagagcctgacagtagggcacaccctgcccgcaccctggcctccaaggatactcctgtgagtcagagggcttgggattctcccacggattggacagatattttgacagtgcccccactgtgcatgctggggcacaaaagtacagaacaggcaaacccaatgccacctgtgtcgaagccagtaccatcggctctgggcatctcccacccctccctgcagaagtgggcgtcctccctctgcagccaaggggaccggcgtttactcaggttgactcctggccaggagtcggggactcctctttgtgccccaacacatccttctctcagccgggcatctgtggccgtctcctccccgcctcgcagccacctgagccagcagctctggcctggtggtcgcagctctctcccgggtctccctgcttccactgtggccctcctggggccgtgtgctcactgtggccttccttttttttctgagatggagttttcctcttgtcactccagctagggtttaatggcgcgatctctgctcactgcctcccgggttcaagcaattctcctgcctcagcctcccaagtagctgggattacaggcgcatgccaccacacctggctaattttgtacttttagtagagacaaagtttctccaagttggtcaggctggtctcgaacttccaacctcgggtgatctgcgcgcctcagcctcccaaagtgctgggattacaggcatgagccactgtgctcgactggccttcttctttcacaggaagcgacagcagcatcacccctcggtgctcacctggtgaccgtctgccaagggcctggtggccccgccaccctacctggcccatgctccatggggttctcggttcactctcgtccctccactcacacgtatctggccatcaagtaagaatcaaaataaaaagttgcacctggcctgcaagtgtgcagaaccgcaccttttgttgatccaggaagctcaagccaggcagtgtggcgctgggtcaccatggcaccattgagagcttccgtctgcaggtccccacgcccacagcacctccctttccccctgggcatttggataccacatgggcatctccccttctgctggcgaaggctacagaaagttcacagctgtggagtttccaggtggctgaacttgctgaggctgctgtttgctgtgcgcgtgccatgcctgaggccctgggtgctgtccacaggcaagagggactgcggaggccccgcccaactcctgtgtgaaacttagctcttgtctgtgatgagtgaatgccgttgttatcctcggtactggtctcggtggagtacagggcgaagaatcgcagtttcatttgagggccacccagacgggaagcacacagcagcctggggcccggacacaggggcttggcctccatgagttttctcctctgccggttctttcttttctgtcttctcgaaggagctggactccccattccaccatccttcttatacaatgtgattcctgacttttttttttttactggagaaaactgagttttattcgtatatcattcaaatcttaggaaatttgacaggaaagagtttcacaatgagctggagtttaggaaggaaagaaaacaaagtcgcccctgcaaagccagcctcattcatattcagtgaggtgtcactcacaccacctggaaaccaccgtgcttacctaagtgtttagaagtcataacttacacagaatcccattgtgcacagcacttccctgtttccagccaatttcttctttcatttcagccaaagaacagcaatctctttagtcctttcagtgaagattgcagaggctttcagaaccatggcaacctggagagtccatgtctccccatctttcctggtgccccagaagccctgccccagcgcctccccatctttcctggccccccagaagccccgcccccagcgccctccctgctctgccttccccagagcacttgcattcttacaccctcagtcacgtgtttcctttcttccccgtggcaatgaagccccttggctggtacttggcttcctttgatcgctgatggagcccaggttcccccagcagtgcctggccctggtggggcaggataaatgtttgtgaaactaaatgggaacccaggtctcagcactgtgtcaggttctagaatcttctttgatgtctccatcctgcttgtttctcactcagcccttcgtctggcctgacatccacaagaatcccctacctcaatccctcctatttccagtgcccccatcccaccaggcctcgttgccctgggtcttgctctctgcagaccacaactgggcaggccctctttcacaccagctcctcaccaccctccaggtgaagccttcgttaaaaccgcattttctgtagaggccaaaccattgtctgacattcaaggccttccttcagcctcctgccccccgtctcagcagcagccgctccactgcacctgcccgcagcacccctggctggcccctggcccggcccctctgccatccgtgcagctcagagccaggtggtcttgccgggaggttgcctggcccaccgccaggatccccatgtaggtgcctgacccagtacatcaaagcatgatgtcgccatttttaccaccacagtcctataaagttgtttcttgctaacgcatggatgtgtggacacaggcctcacctgtcccggcccccagcccatgcgtctgccctctgcacttatctgtgttcctgacggccacaagtggccgtggagctgctcaggatggaaggatggctggagacggtctgtggcctgtgtccacatgtcccgggacccagcctgaggtgccctcctcacccccagacacccatgcatgtggccccacaccatgtcactcccacgctcatccgtccagccccagctcccagctagagtgcagtcccatgggggaccacgctgctgtgtgctccacccgccttccctcccgaaaccctgcgtctcggccagagtccaagcacacccgtgctgagaggcgaggcgggagttaattctgctcgggactctggtggcctgagaaggctcttcccgcagaaacagcctcatcccgagagcgctggcaggaacgcagatcagaggcctgggctagatgggaccagttttcacgactctgctagatacggtgacattttttacggttttgaaaatgagttaccatagaaatggatccaggatggactaatgcaagggaggggagggcgagaaaggaacacagccctgcggagcctggagccggccctggtgcagctgtggcaagcgccctgctcacccagaggaggagctgggggccctggccagcggcagagccagaagccccgcaggccgcctgtgctctccacacctgaacacgggattctgcgggagagctggtgtcaagtcctgacccctctacttcgttccgaatctgggagccagaactactgcctttggaggaaagaggagcccggagacccgagcccagaaactggggcactgcccggctcctgggaggccacagaacagtggcggcccctgcaccccaggcctgcccaggcctctcagccgcacacattgcggccggctgcactgcggcatcattggtgttcacaggacgggccatagcaactgcttctcccttggtttattttttaatgtttcttaaagacggggtttcgctgtgttgcccaggctggcctcgaactcttgggctcaagcaatcctcccacctcaccttcttgggtacctagaactacagtttccttccttttttccaaggcatcgagaagctgaaagagtccttacaagccccgcgtgcagctccagagacccccagtagtgagttccggccaggcctcgaggtctgggtttcagggcagagaaggtattggtttctgcctttgcagaaaaaaagcctggtgctcgctcaaccaaaagaaaagctaggcagggtttttgccaaaggaactgtgtaggtttggaaggaaaaggcttcacaacccagaaactggagttactcttgtcagaagacggtggtgagaaaatgaacaacagttttccaatgctacaggattatgtttttaggacaaaagtccttaactaaaggccattatgatgtttgtctcgtaggggtactgaatatgctgagaaaacgatgcagacgcaccgcccacccggcccgggaggtgctgcgtcttccctgtgggcagctgcagggcccacggctccggccggcccaggaggagggagggcggagcggctggtcagcgtgattctcgtaacagccacaccgagttgtgggtgcagcccctgaggggtcaggaggggtcacaggaaaggggccgctgcggaagccctcggcctggggcactggttccccaggatggcagagggtcttggccatcacagactgggtgagcacatcagagggcgtaacccgctctgccaacccctcagccttggggtggcggctggcagctgtcacctgcaggaagactctgtcttctctgaactgctccgacagccggggagcttctgggattcagagtcagccagagctctgagtaaatttccccgccgtgtatgctatttggaaagctgtggccattgggctctgaacaataacttctaaaaccattcattatgatcttttattacttttagtctagacatgaaaataggttctccgtgcttacagggagttctgtgagtgccagcaggggccctttctaagctcaacatccccggtccctgactccctgccgggcaggacccaggcagccccacctccttcctggtggactcgaatccgatgggaagttctctgcggtctgttttggggactggcagattttacaacaggacagttcatacaacggagcctgagagaagattgtggccaaaccagggaaagacgtgaaataaagacagcagttccgtgatcacagcgtcatactttttactagtacatagttataaaatccactgtcactaaaaagactggcaaaaattagatttttttttcccctgttgagtcgcaaacagtatttcgactttgatataagtggaagtctgcacgaaggtcgacaacaatagcgttggccctcggtacgcgtgggggactcaagggcccagggcccacgacgctcagtcctgctaggaaaggcgtgacagctgtgcatcccccacacacatcccccatcgtgcttgcatcttctctagtttccttataatgccaaacccagcacagtgtgtcaacagtggttatgctctcttgtttttttttttatgtgtattactttttgttttgttttcaaatattttcgatctgcggttggttgaatccatggatgtagagggccaactgtaataaaaatctgtttttaaaaattagatgaaagtggccaggcgcagtggcgcatgccggtaatcccagcactttgggaggccaaggcaggtggatcacgaggtcaggagatcaagaccatcctgcctaacacggtgaaacccgtctctactaaaaatacaaaaaaaaaaaaaaaaattagctgggcgtggtggtgggcacctgtagtcccagctcctcaggaggctaaggcaggagaatggcatgaacccaggaggcagagcttgcagtgagccgggatcgcgctgctgcactccagcctgggcgacagagcgagactctgtctcaaaaaaaaaaaaaaaaagttagatgaaagtagcagctaatacatctcacacacacccccaccccgccctgcacattgccagggtccttacctggagtgtcctgtggagccctgacctagaccccgggtgtccgcgtctgtggcccccacattgtgggtgaggcttgagcagccaccagcctgcaccctcctcgcagtctgccagggccgccgggagtggggggcctcctgccgtgcctgccctgggttccgggcttgcccagtgccctattcttcacagtggcctggtcctcacccccgggtcttgtgaggagggttctcatataaggccagctgcccctcacagccccttcacggggcagtcgagcctcgtggggagctgcttcaatgcctcactcagctgtggggagcccaggaccccagaataatcaaggggagtgggtctcaggtgggcagtcatcaacgggcatcttacggggccatcctgtcacccatgttagagagtgtcgtggagctaggcggtagcgaacttcgccagtgaggccgcatctcctcctcaccagggcctgtcgcgggagggaattcaaagccaaatctcctagcccacccacccactctaaaaaaaaaaaatgaggacgcagccatcgccgatgtccttgtgttgcacggagcagttcctaggagccggctccgctggggtagaggagactctagggatgttcctacagtctggaccgattttacatttccgagacttgcttgtggatctacacggctatcgcagagctgtgcaatctgagagctggaaggcttcggttctgtcccagtacacgcggtgcaggaccacggttgagcagaaggtgcatctgcgtggcaccgtggcgctgaagtccaggtgtgcttgggccctaggctcccaagacgttcccactgcctcctcctgggcacaaggctcaagcacagggaccgccggccaggcacacatgtgtatgggcaagacccgcaggggacgtgtccctgggaagaatgcttcctttggttgaaggctgtaaactcgccctgtgaggtgagacatgtcagctcccagaaaaggtcccagcctctcatgattcacgccagcacaggcagcacagcagcagagcgtgacctcctagatggcagcgtgacctcctagatggcagcgtgacctcctagatggcagctgagctcaattccacacggctcagtcctggagacaatcactcactgcaacacgcattcctcatgggggcctcttcaggagccacgggcatggggcttccctgacctctgcactcacggtgggggcgcgcacagcaggggtagacactggcccgccatatctggagctgaagtagagcccgtcttgggctcgcttagcggagaccataggtggaggtgagccagtggcctcaggcatctgcagaacccacgcacacattgactttcgcacccgcctccatctccgtggacttgactgtgtcgtgcaaaacccactccacgtgcgcagctgtgttcctgcagtgacacgaggccctccactggctttcgatgcttcagctctttcaccaacaatcaggtggactggaatcacacctcactcgaaaccctttgaatctctatttagtgaacaagcacttgcttctcagcaaattgtctagcttccccaaaaataaagaagatggagttctgtgtggctggatcccttttcagctcccagcactgagggcagggccctgtctgcctccgcctctgggttgaagcctggcagtaaactggcactcctggtgcccgcaggcaggggaggcagcgcctggccccgctctgccctccacgctcagcgcctctggtcctcggcccagcccttgctggacatgcagcctctaccaggattgctgcttcccttctcggcctctctgggtccagcgtggcgtggacaacagttcggcaatgcctgctccatcagcctcctccctggcctcagccaatgctgactgtgccaggagcccacatagcccgtgcctgcccccccttctggtttccaagtgctcacagcctccaccccacaatctctgattggctcctgcaggcttccgtcaggtatcccccaaggctccgcgtccccatcacctccgtgttttattgttcaatgtcttagatcttgtttgtgctaccccctctcgctccacccctcctttgcccagagaatgatcctccttcccttcaaagcccagctccttcgtgcctcttccaccaggccttcctggccttcacttcctagcccactgctgacagaaggagtcactctcgctccttcctgcatctccctgaggccgcacgctgtcgtggacgtagcatggctcaaaggtttgatgggtgtgcgttcacatccttcatcctctgggcctcaccttccttggcgacgctgggggtaacacctgcctgtaggattgctggggaattaaataggaccgagcagccgcaccgacgaatcctcaccgacgaagcctcagcgcttccctccatgcccacgactcaccagtgttatttataaatgagtctgagtccctgctgggtcctgccttgtctgtctttgtatccgagtatgcagcacagaaccttgcattgagtgttgggtgagtcgggagaggcttagggacaaaagtcacagcacatcaacctttcgtgaagtcctagcatctcagagcagggccagtgcctggaggtggacaggaagcacgtggaggtgggcaggaagcactccctgggtcacagtgcacagcagcacgtgctgaacttggtgcagtgcagacgtccatgccacatgcaccactacccatgggctgcggcagctcctagaaatctaggatgtgacatcagacgctcctccgggagtgtggtcatgccctccgatccgctgaggcatttcaaggaaagttacaccctttccaacgcagttttccttttagaaagatttggcctcagtagatgaatccatgtgatcaagcctagtgatcagctaggattcttgaatctcgggacccgttgccagaataacaaaatgggggcttcctgtaacctcggctctttaaagcaacacttctgataccagggttagggtttcagaaaatgcagccgccttaggagcctcattggcagctactttccactaaaacatcttccatttctctctctcaggagtttcctttaacagtgtttacactcagatttggagagtcctgctgcacctggctgctgacccctatccagaggtctcggacgtggccatgaaagtactcaacagcatcgcctacaaggtacgtgccgggcgctccccaccgcgctccagctgctggttctcggttacgagtatgcatgccaggaactccaggtgtgcccgggtccacaccacagtttagaaagtaacaaaacgagcttcagcaaatatcttaaatctggagatgtacacagtacaccccaaactgtgtctgtgcagctcccacgtgggcagagggtgctggatttactgatgcctgtcaaggcaattaggggaggactgacattatctttcaggatcctctggtgtctgggtgagctacagtgctggcccttcttccattttttttttctttctttacttaattatttataagagatggggtctccctgtgttgcccaggctggtcttgaactcctgggctcaagggatcctcctgcctcagcctcccaaagtgctgggattacaagcgtgagccactgcacctgttttttgtttttgtaagacagtctcactctgtccagactagaatgcagtgacctgatcacggctcactgtagcctccaactcctgggctcaagcaatcctcccacctcagccttggaagtagctgggactacaggtgcacaccaccacacccggctaatttttaaattttttgtagagacagagtctcagtgtgtcgcccaagctggtctctaactcctcagttcaagtgatcctcctgccttggcctcctgaagtgctgggattacaggcatgagccaccacacccagacttttcttccctttctgatagcagtaatttttgactcattcaaaacccttctagttaatggtttcttattcatggccattctagctcaagggaacttttcaaagaatcagtttttggtttcattggtttttctctgttgtttgtccattttccatttgattgattgagctttcatcaataaagcttgctttcttctgcttactttgagtttaatttgctcttctcatcctagtttcttaaggtagaagcagaggtcattgattttagtcctttctctttggggactgtaaactcttctcagtcccttttgtgagctctgggcatttggcctaccgccttcccgctgttttttctctgcctcatgggttgtcactctacccttgagcagatgaatacttagtcaaagaccccaggggcctctcctgcagaccttggaagctttcccctctccagtgctctgtcctgcaaattgtcaccacctcagcctccctggagccccagtctctgtctcctgttccctgaaagtgctgggctccccgtctctgcactgtggcctgggactgcctgaaactacctgcaagccggacacagggcagctgtttatttccgttctctcagggatcacaagcccgtgacacccagcacccagtgtccaaaaacaattgtttacggtatttgtcctggttttctagttgcttatggaagttggatgatttatgtggaattagaagtcactcattatagcacttaaaaattttttggtaactttttgataaaacttcaaaagcttacagaaatgttgcaggaagaatgcagggaaaggccacactcttgcagcctctgtggtgttctacgtcttcatctgacctcgtcacggctatggcgttgcctcgggtatcactcagtgccagggtctgcagggtcgaggagccacggcttcccatcctagtccatcgctttttccaaatgagctatcgagtctccccctctcatttgctgtggccttctgggtcctggccggccatcgagccagggttcctgcagctcctcagctccttttgctgatattatacttctgtggctttcggttccttcaactaagttattttctgttggtctagttatatcttagatggaaatcaccttaccgtctgcagttggttcttcttcagttctttttttttttttttctcttgctctgttgccaggctggagtgcagtggcacaatctcagctcactgcagcctccgcctcccaggttcaagcagttctgctgcctcagcctcccaagtagctgggactacaggcgtgagccaccacacccggctaatttttgtatttttaggagagacgaggggtttcaccgtgttggccaggatggtctcggtctcttgacctcgtgatccgcctgcctcggcctcccaaagtgctgggattacaggcgtgagccactgcgcctggcctgttctttatggtatcaccggtatagtcacaagtagcctattggccaacttggaaaggtccagattgtttaattctgcaccggcctcccctcctgcagcggactctgccacttccttcgtcaccgcatccctgcagcggattctgccacctccttcgtcaccgtgtggtgtggccagctgcacgggcacctggagacgttcatccccaggcagcaggccatctcctcaggtttcttttatgtgctactggcctgttgaaaatagccagtcaattaagttaatgttttcattatgcggtaagaaaactaagaaataatataattatttgcttttaaactaggaataagataaatacaaaaataaacctcaggctgggtgtggtggctcacacctgtaatcccagcactttgggaggccaaggcgagagacgatcacttgagcccaggtgttttgagaccagcctgggaaacatagtgaaaccccgtctctacaaaatagtagcaagttagccgggcacggtggcaagcacttgtggtcgcagctacccaggaggatgaggctggaagatcccttgagcccaggagctcaaggctgcagtgagctatgattgtgccactgcacttcatcctgggcggcagagtgagaccgtgtcttttaaaataatgtttaaaaatatatgtttgttacacattatggtctgagaccaagaaggggaggcagtaaagcagacaggaaggaaataaggaagaaaagaaagtcataagactgcacaaacacccctgaggaaaccacccacggaggccccagaccagagcaaccggtcccgaggcctctcagatgagctgacgctctggaggattgggactgaaaccgtcacatctgcctgctacggattagggaaaatcagttcttaccacttaccactgcccttttagactctaaatagcctctaccacttttagtttaagatttcaaggttgggttttaaatagccgttttcactaaaatagttgtaaaagctttttacgaacattaataaatggtttaagtttttagaattgatggccagttcgcgtctctgctggcagttctctgacacacaggagtgtctggtggcctcttcttttctcttggaggcacaggatggctgtggccatggaccacccttgctctgtcctgactgcacagttggaggccagcgctatttaggaggtttgatcgttttcccccaattaatttagcttcttgggtattttgatcatgatgaaatcagtattcagcctatttaagtttatttttcagtggcttttgtgtatttaaccttactgaaaaattagcctgaattattttaaactgtaatccgagtgcctaatcttgaaatataaggactattaagtgcgttcctgtggacctggcctccagttgttaaatagctcctcttgggaagctctcgagcctgtgtagcacagaagccactgctctctgctcttcagcaaacgtcccagcacagcctccacagcccagcgcccttttggattgtgtgtgacatgtagtgtagctggacggcccgcccccctctcccaccacggtaaggcagttaagcacctgcgtctgcctttcatgttagcaggttatagcaactcgaacacacggctttgtcgtgctatccgattgagacccagaaaccgccataaaagtggcatttgccttctgtgcctgctttgccgttctagaatgacacagagaccttaaggcacatggccatcactccagcagacatgccacagccagaggggtggagaaggtcaagagaaggcctctgctagagaccttgctatgcatagcacaatgcagcatgagcttgtgtgtgtgtgtctgtgtgcgtgtgtgtgcacgcgtgtgtgtgtgtctgagtgtatatgtgtgtgggtttaagagtaaacattgctactaaagcatttggaagcataaatctttcttgtcttcattttaatttcaagaaatgccttattttcctgctctaggaactgaagggattacatttcattttacagagaaacgagcctattttagatatttaactctgaagccaaatttttgttcatcagagtctaaaacagccttattactatggaatgccctgtagaattctatattcaaatacagaaattgccaccagctctgtatgagagaacccacacagctccagagctgtggtctgatttcatgtatttataatatatttcgattcccattccatgggcttggggttttcattttgcttttagctcccttttctcttggtttagttttgggggtgttgtttgtttgttttgttttgagacagggtctcactctatcacccaggctggagttcagtgatccagtcacggctcactgcagcctcgacctcctgggctcaagcgatcctcccacctcagcctcccaagtagctgggactacaggggcgcaccaccatgcctagctaattttcgtattttttgtagagatggggtttcaccatgttgcccaggctggtctcaaactcctaggctcaagtgattcacccacatttccctcccaaaatgccaggattacaggcatgagccactgcacctggcctgcttttaggtttttttaaggaaaatttcagactatgtagaagtagaaagaagagactgatgcccctcaggagcctgcctgtggccccagcagttctcacctcagtggttttaggacaatgccaagaaagaaccttcaagccacaggtggtcacctgtcagggcacatgttctcatgatcactgcttatattataatttatgagaaaacgtgtgagcataaatgcacaaactcacctagaagcaccgctgcagcctcttgatactgtgaagagtgtgtgtgcatgtgcgctggccgctgcctctgttgcaggactcatgcatgcagacggagatgagaaaggggtgtacttaacgaaaggtcaaattgatggcagtggcagccagtctgggagcggccactgccatgatgccagctacagctggggaggtgtggccagggccgtgtgctccacaaagctggcaggaggcagggaccggtggaatcccacccccttccaaactggcagggtgggagcctcatgctccccaggtgcagctacagccacccagccacaactctggatccaggcatctctgtgctcttgggggccgggagcaggcaggaaccccaccctcccaggcacagctgcagccacccagccgtggctccagacccagccatctctgctcttggggaccaggagcgggcaggagctccaccctcccaggtgcagctgcagccacccggcatggctcctctgtgctctcaggggcccaggaagtgcccctacccctgcaggcttggaagcgtctgctcccgctccctggcctctccctgctcctggcacccacttcaatctcggagcaaagttgaggctgtacccaggtgctgttgcaaccagccggctgtgcacacgctcggggcagtgctcacatgccaaccacctgctatgtcagccccctctggactttgggcaccaacgagcatgggagggaggctgagggtggggactgagggcagtttggcactggcctgcaggtgcccctcggcacaatcagcctgggtgttatggatgatggcaggaggcagacagggtcctgggcagaaaggggcaggtccccagtgaagtgccaccttcaagccagggacagcctgaagcctgggggctgggctgatggaccagaatgggaacttttagtgctttttccaagcctgcccatggctgcccatgaatcagtcagcacatacttcctcccctttgaagcccataaaaaccctggactcagccagactcaaggaaacgatggcataacctgccttcagaaaggagctacccatgccggggtctcctctctgctgagagctgagcagacgttgggaaaaccagctgcagagaggagctgcacactccagggtctcctctctgctgagaactgagcagacgtcgggaaaaccagctgcagagaggagctgcacactccagggtctcctctgctgagagctgagcagacgtcgggaaaaccagctgcggagaggagttacccactccagggtctcctctctgctgagagctgagcagacgtcaggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcggagaggagctacccactccagggtctcctctctgctgagagctgagcagacgtcgggaaaaccagctgcggagaggagctacccactcctgggtctcctctctgctgagagctgagcagacatcgggaaaaccagctgcagagaggagctacccactccagggtctcctctctgctgagagctgagcagacgtcgggaaaaccagctgcggagaggagctacccactccagggtctcctctctgctgagagctgagcagacgtcgggaaaaccagctgcggagaggagttacccactccagggtctcctctctgctgagagctgagcagacgtcgggaaaaccagctgcagagaggagttaaccactccagggtctcttttctgctgagagcagaacacttatcaggacagtctgcctccggagaggagctaccaactgtgggtctcctctgagctattctgttgctcagtaaagctcctcttcagcttgcttaacctccacttgtccgtgtacctcattcttcctggatgcaggacaagaacttgggacccaccaaatgtcagggctacaagagctctaacacaaacagggctgaaacatgccccttgcttgccactttgcagatgacaagaaggagagaagagaaaaggagagaagagctgcagcccttcagggaacccagacctaggagctccctgagatagggctgtgatgccatctctggggctctgcagttcctggcgtctccaagcttccaggtgccaccacgttccccagtgccagatgttgaagctgcttgtagtacacctggcccagccacagccttgcagggagcaggcacccatgccagtgcctagagctgcccacccccctgcagccagcatgcatggctgcgcacagtggctggaccccacattcactctcacacccctcaccactctgcgcctggcttgcctttggcaggtgtgagatgcgggccagcagtgtgagccaagcgcagcctgccaggctgaatgggcataacaagcccagtgggtccaagtaaaaactcgggcaaaggcgtcaccagccacagaggtttctggctggcaaagcaataccccaaggatcccatgacattttgatttacttataaaatgaagacctaagttactgataaagtaaataaacattggccgagtgcgatggctcacacctgtaatcccagcactttgggaggccaaggcgggcggatcacttgaggccaggagttccagaccagcctggctaagagtctctactaaaaatacaaaaattagctaggtgtggtgatgcactcttgtagtcccagctactcaggaagctgaggcacaagaattgctcgaacccaggagacggagattgcggtgagccaagatcacaccactgcactccagcctggcaacagagcgagactcttatctgaaaaaagtaaaagagaatgaaaataaagattgagatatccaggaaagcatattccaaagcaccaaacatcctaagcctgatgcctggcttcatgctttcgtagcatgagttacttatggataggtttcattttttttttttttgagactgagtctcactatgtcgcccaggctggagtgcagtggcgcgatctcagctcactgcaacctccatctcccaggttcaagcaattctgctgcctcggcttcccatgtagctgggattacaggcacgcgctaccatgcccagctaatttttgtatttttagtagagacggggtttcaccattgttggccaggctggtcttgaactcccgacctccagtgatccacctgtctcggcctcccaaagtgctgggattacaggcgtgagccactgcacccggccatggatacatttcttttaaaatcacattgtcatgccagaattttctctcctcctacttgacagcctctcttagaacccagagagcccggtctgtgtctccctaccctctgttctctcaagctgcctgaatcgtaaggatttcttaattcagcatgtttgcaattaacctctagaccaaagtagttctgcactgctaaaactgtctttacctctgaaattctctgaaatttctcttccagtgatctcagccgatctgcatatagatattctgatttctttttaacctcgtcaaatggcatttccttaactgagacagacagttctctgttgccaccgtgatccctccctctagaactgcacctctctgaagccattggactctctcccagctcagggcccctccgggaatcgtgagctctacgtccagcccctgaaggccgtgctgcccatcccacccctgcctggtttcagcggtggcctgctgtgtggaagtgtctgactgcctctcccaccaagccacgggcgtgcacaccctctgcatcctcagcaagcgttcacctcacctgtcttagttcctgcacctccaccacaaggatggatgctcagaacagtgggatgagccgccccaggaatgtggcatgccagcagcactaatgaacatgaacagcctggacacatgtcacacctatggcttgaaagcttgtcatgcacatgctcattcccctcactgcagacctggggaacgagggcagcatcagcctggactagcatagctacagaatcagatgtggccctgccttagagccacgctgcccaatgctggcccgtgggcccctgcccagctagagcagaggcacccctggatcgcccatccagacagagatgccctgttcccctgcggagatgcagactccaggctctggggtggcggccgggaatctgttctcagtgagacagtactgtgcagctgcaggcagcggctgccccacgagcaccctcgcgggggtcatagccacgagcaccctcgccggagtcatagccacgagcaccctcgccggagtcatagccacgagcaccctcgcgggggtcatagccatgagcaccctcgcgggggtcatagccatgagcaccctcacgggggtcatagccatgaggcactaggttggctcttggagcctggggctccttcaggcaaggacaagcaccagctttgccctgagccccattctagttctgctagctttcagccagtgacttcatgcctctcagcttgcatttctcctctataaaacttaaaactgggatcattgtatgactcccaccccctagggctgtggtaagaaaggcagagccccgtccctgtgctgcctgggtgcagcgggggctccatacagcaagctgcatcgtcagcactcgtgtctgtgtcctgtgccgcccaggtgcagagagggctccacacagccagctgcatcatcagcactcatgtctatgtcgccatcagctccttggccatctcaccatcctctgtggaaaaggggccacagcaactccagaacctcccgagccttcccacacacccgggtctgaggagggaaggagctggtgggctgagacacctcggcctccactgacgcggcgttctcttcccgcagcgcctaggactgagggcaccgtggccccaagtgaaattccttaaggcttcctttgtaactaatgggcatcttgttaagagtcaccacgttgctttaatggaataatacctaggacttacttttccaaaagaagagttcgtaggatttatctaggaaacgcagtttgcaggaaaatgacttgaagaaatagcagcacacgcttttgcaggggtttcttctcccccaccaagcagccagcggcctctgcgctattcttagcccaaaagtgcctctggataatcctctgggaatccctttttaagagtttctcacacatgaatccagatcctcgatataaaattaacaggaacatttctgaaatactccacttcctcccaagatagagcagccagaagctgacgctggcatccgcagccctgactgtgtcaagatccagtgggaaaattcactgtccaagtctctgaaatgtacggtattttcatctgcattggatcagacgcccccgtgtccttgtgaggtggcgctcccggaacaggagacagggtgggtctcattccagtccccgcttcagcagctgcaacagtcgggggtggataaaagacacctgcacctccatcttccaggcgtgttcatgtgcgcactggcccaagagagtgtctgtgctgagcattcgactgttagcaaagtcgtatctgccaccaccgaaggttggcttggggagtggaagaaaggccctgtcttgtagccgggaccttgaccctcttacagctgccgtcctctctggacgcagacctccctagagggcatgtttgcacacccttgacctctgcaggctgcgagtgagccggggctctgggggtgtacatgctgagaagggcgccgtgtcctccaggcaggcctgggcccacagaggctgtgcgggccgcactcagccctccagtttgcatctccaaacccagcctctgccattgccgtgccctctctgttcacccttcctggtgctgcgctctctaagatggtggcagggaccagcagaaaggactctccctggtcctctgcctttgcccctgccccagccagctctgcagctcctgctcgctgcgtaccctgtcctcacaccgacaccgcaggcaggcaggtctgccaggtcacctctgagggacacgctactcatgttcacaatcttggccccacacccagcgcaatcaacgctgagtaaatgttgaacaaataagaagtgcacagctaaagaaagctccctccaggccaaccccctgtggtcactacactaatgggggtggggggggctcctgatccaggtgtgtgtctgtctcacgagatttccagaagtggtggaaaattagttttgtgacagcagccccaggtacaagccatgtgaaagcaggatggtctcatcttataaccccaggggctgcgagaattcatgccgaggcccggatcagttccctgcctggaagagtgggcagagcagagggttcgtcaccacggctccatgcggtactcccacgggcgcttccgtgcagggtggcaaggcgggagctgcacagaccccaggcggctcagcgtgacgtcccagggctcctgagtcaccggccccagcccagcagcgcctgagcctttgtgctccgtgagcgtctgagcatgtgtgggttttgctaaaggcttcatttcaactccagaagttttctgtcttccccgtcacctcccactgtttttccagacattttgagaaggcacatataaagttcacagtcgaaaacttgcttttctctttttagacttttgaagggatcatatgtctggcaggttctgtgggatggttgtatgtgtctagggctggccgaatagtttaataccaaaacaaaacaagctcagaaagaacatgtattactcttgtcatttaaaaaataggaacgttgcttaaagacaagttatggttccattttcttgctatttgcgttttgaaggaaaggacaatctgggaagcgtgggtgttacatgagtgaagacttcaggatcgttttgttttccttggtgttctgttggctgaattgcaggttcaaggttcctaaattctaagtgaataattaaaagcatgagacattgcaggctccacgcggatgcggacctgaaggacagggttctgtctggctggagcgcagcctgggatgggccggcgctcagggaatggcttgtgcctgcgggatcagtgggcaccttcatggagcagctggccccatcctcctgacacagatgaggttgccccagcaccatcaggccccttctgaacgcgcacagcctctggagtccagaacccagcgggacccgcattccccccactgagcagtgtactcagaacaaaaccaccccgaagcacctgggccctcgcgaggtcatgtcggtggccgggcagcgcacgccctgccttgcgtggtttctcacggctgctcactaacgccgacagctggtctccagatccacagaaaaccctgctttaaaaaataaaagcaaaacctcttgcctcctgaatgccagggctcaagctggtacaaatctttttctgtggtagaatttcaagccctgcaggtgtctgtggcaggaggctctcagagcccagggtcttggcttcatccacagacggctgggttgaaggggtggtttggagcctcatgctgcccactaggctgtgccagctgtgcaccaccctgctccccaccctccgggagcagccatccccttcccctgccagtgcgcccctccccagggcaggtttcagccatgtctgccctggagatgaaggttccccgtccatgcagtgcacccagcaccacctgcgtgcgcccgtgggaaaggatgaccacagcccctcggccaggaggatgttaagggcggtcttgagttccaggccccgtcacagtccaggcagcagagcccattttgccactggagagagcccaagccccctgcagtcattctctgacagtttctgtggcctcctgaagcacacgggggtgtaaacagtggcctgcgtggaggcctcaggctgctggtggctttccaccccgtgcccaccggccaggtcccgggtggatgaagcactccctgaccctccgtgaatgccacatcgcccggctccggaaagagcatggctggtggattcttcccgggcctcaactcgcagcctctgacccgagagctgaggtgttggggagaattggactcaaggctgggacagtgtggaggcccagcctcaggcaagggggaggacactgaggccgccaggagccgcccctctggcagggaaggtgaggagggtgggccgtcatccatctcagaggcttcaggccctgacccctcaggagcctcaggcagagcttcctccccagacatcccggctcacacggccacgccagggctagcccagtggatgcatgtccaagagtaaagaataccacttgagcttcaggattgcctttgcgggggatccagctggggccttccattggtgttggtgcttcctcggccaaaggccttttctgtgattctgaagcggctccacgccagcctctgcttcgtgtggcggcctccgcggagcacgtcccgtctgaccttcacacccccattcctttgcccctaggccaccgtgaacgcccggccgcagcgcgtcctggacacctcctccctcacgcagtcggcccccgccagccccaccaacaagggcgtgcacatccaccaggcggggtaagtgccgcccgctcagcctgcaggtccgtggtggtgaccggggccccacgggctgagctgtccctgagccggcctccccatcctcctccttccccgccctgtcttggcttcgtctcctcccccctctccagcgggcgttctttccctctccctcccggacaccccggtacccgcctgatctgagccctgccttgagctctccccatcttgaggaacccttcatgtgcacatcatctcagcaaaagttgaatgaagcctggtctctgtggcctttcagagtttgtaagaggggatctagatctccaaatgggtaaccaacaggtgtttgcacctcaggacgtggcactgctgtgtgctgagctcgcacatcccggcccactcgactctgagctgggttcgtcctgtccgcgccacctcccagggtgctggagttcaatgagggacaaccctgccccctgccaggcgggcaaccgagcagcatggactcggcaccagcagctggggttcgggagccatgatggcatgctgggtgactgaggacaccccgggccctggtggcacctgggagggtgcaggtggcccaggaagttgttccatgttccctctcgaagccccagactctgcagaggatgcagtgtttgtttttcttccaatggcaggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcaggtacgggagcccggctgcctggtgatctggacactgagagcgttgcttctcagatgggggctcatggcctcagcctcaggctgctcacatcaccatgggatggggcaggacccaccctgccgtcctgggtctgtgggccactctctgcctttgcagacccgggtgctggtcctcactcgtgcacccctctgcctgcactccttaggagcactgctgggtgtgtcccggtccctctgcctgcactctttaggagcactgctgggtgtgtcccggttctccgcccctggttctggtttcaccattctgggcagcttccatgtaacgaaacaggagcacggagttacctggctctgcccttcctgggcacacagcactctgcgtccgcttgggggcagctgcactgcagagcatttgttctgaatgtgttgtcttttctgtgaacatccaagtacgctgcataaataggtacactctctttgcctttaactaagttgaaaaagatatttctggagagaggaatgcctgctttgttttgccagggttatgagagtggtgtgaggtggcagctggtccggagacctcggctgtctcgtccaggtgctgccactttgtcagttgagggcacctgggctcaagaaggtggttcagggcgcacccagcacacccagctgctctgggtgctgacagcatgatcatctcagcaatgagtggggtccggggctcgcttggtaatccagtgattttaaaagaagttagcggccgccttgcaggatgccctggagcaggaacggccatgttggggtagaagagctgtcacggcaagagcggacaggtccccacaggtgctgctcagccccagcccacctggactttccgtgtctcggcagaggaggagcgagaatcaccaccgagccccaagtgcagggtcagcctcctggccaggccctggggagcaatgctaccggcacgtgcagctcacccacccgaccccccggggtgggggggatgcacctctcactgcacctgccctgagatcatggggagctccctgtgccaagacacagcgtgagagacgccagcaggccacatggcgtggcacaggagacccctggtgcccagcctcactccacaagcacacacagactctgacagccctggccgccacaggttccacaacaggaaacacccaaagctcagtcctcctcagctccacatcctctttctccagtagctgggagctccagccggcctgcaaagctgtgcgctccgtccaggccacttcacatgggagtccccgctctcagtctggtgtcacggggccatcacaggagctgtcctggaaccaagcggcagaggctttttgggggttgataaaccagcacacatggacgcacgtggcattgtctgaacagtcagttagaattgacttgggagctgtgctgggtcggccctggggatggtgggaccgacgtggctcacacttcacagcccgggcccctcaatccctggccagacgttcaggggttcttggtcaccaggatacggaagtgagcagagcacagaagtgccgtccttaggggcagcccggtgctcccggcagcgcctttgtccccagctgcagctcttttgagctcaggagtggcatgactgactggtgtttctttttccttccaaccctcctgcttaaaccctgaagactgcggacgacgcggacgatgctgctggacacaaaagtttcatctccgccacggtgcagacggggttctgcgactggagcgcccgctattttgcccagcccgtcatgaaggtgcgcccggggtgtggggttcagagtagagtcctagcgaacatgtgtctgtcccacttctttgagcataaacgctcaaggcttgtggctgtgggagcgtcccattgtggtcgtggtagtgatggtcacggttgaggtagaaccgcagaagaaacaaacttcacttaccttcctgtcgccaaacgaaaagagaaaacctgcctcgctggagcttcccagtgtgacaggtgtcactttgccttaactgacagggtcaccacaggccttcccactccctaatggtgaggatcactcgaggcccatcccaaggccacgcttgcgtggctccgaggtctggggactgttagacgcagcctgctgcagccaatcctagcgcatttggggttacaccacaagaccatctctgaggctcaaccctgacacagccctaacaagcgccgtgtgctgtggacgcagtggctgtgttcctgcaggctggggcagggcggcggctctcggcctcttcgaggaatggggcgggagctgctttgtcagcacagtcccagtgctcatctctctgccagggcccagcagggactcgtggagattttctataaatctaaagtgcattctgagcaaacctgcctcttccctcatatataattgaaagctgaaactctcagcttattctcgattgtatatcaagcttgcgtcttagtcatctctgtgaatggtatttggaccccatgacagctcagtccctgtggtcctgtcttcatagtgaatgctgatttctgttcataaaaacagaaccatcaggcagcccctgaggcaggcaagccatgaagcttgaactacggagcccctttactgcaaagagagaggagttcgcctccctcttctcacatgaacctgggtggacagtggcctggctgttctagaaagcgtcttgccgggaagcatcaaacgccttaaatagccgttccctttgacccagtcatgaatctgctaaaatactgtcttgagaaaataatcagagatgtagatgacttccgtgttgtttctaagaacgaaaattgagattcacttaaatgtccacagagggtgaatagttaaaaagttatgaaatatttgatgagatattattggagctactgaaaagttaaacattaaaaatagtgtcctaaggaagcgctcatgacaacattccttaaaaagaaaaaatgcaaaatgcagaccaagaagccagatttacagaacaatcacagccgtgcttctcatacagacacagatgtgcatacgacggagaccagcagagcccgctcctaactagagattcgcaaatggcgccacccacgactgcactgaattgggcttcttttgtgcctcttctgcagtttctacactaagcacgaagcacctttagagtcgggggaaaagaatcaaagaaacaaaccccaggagatcattgaggctggtggattcagtcctagtcagaagcccctcaccaggcccacctgctgggctcaccgctgcttacctgcgggtggcatgagggtggcggcccctgcagacagagggaagtgccccttcccatcactaggaggcttctggttaggaaaggaaagcatacacaaatcctggaattggatgcaggaagcaggagccacccaaactctgagtgagccagagctgggaggtggctggacactgtgccaggggtgccaggccgtcctctagaactgcggcccagtctgttgaaaagtcaatggaatttagtctaatgttaacaagcttggtgtccttgatgcggtctcgtgcttaaggcagacaaggtcaggcgactaagaaacccacatggtctggtcttcgctcttgctgggatggcagtggctgtacatgttggtaatttcttggtgtgataacgagaggcttttcttgaagtccttgaaaaatgcctattctcagtcatctatcctatgatgaaagaggaatggcatagataatccaaaactcattgctcttaaacttaaaaatgaatttgacttttccccaaaggatttgctttcctttcctaagcatttttaagtacacagcagctgattgcaggaggaagttccccagaggcatgtggaaggccgtgtgtgtgtctgtctgtctgtctgtctgtctgtctctatgtgtgtgtgtgtatccctgtgtctgtctgtgtgatgtgtgtgtgtatctctgtatgtgtgtatgtgtatctcgtgtgtgtgtctgtgtgtttctgtgtgtctgtgtgtgtgtgtctatttgttccggtgtgtgcaagccccaagccagcgtctcctctccctttcttcagattagcagcccctcctccgcctgccctcatctcctccatttgcacatctgagaattcccgcccgcacggaggagctggagggtgtcagccttgtggtctggccctgccagcaggtcctgctgtgtggacactgcagaggagattagtccaaggggatccatgtaggagctgccatcacacaggaggttgatcaggaaacggttgctgaatgagtaaatgattgtcttcctctgcccctgccaagtatttgaaaacaaatgctcacttggttgtcgttgaaacaacaggctctgggtgtcatgatggaaaagagcgccgtgttgtggtcggcgtcgtctgtaactcctgatagcaactgcagtcttaggagtgtctttaacattagagaccttttccaaacttcagaagaggaagcaggacgtgttttctcttgtttaaaaaaaaaattgttttcctactttttctaggtggtattcataaaggtattcttttactgatttaattcatcatctaatgacatttgtgtaacgagctgcattaggaacttcttgttattagcctgcttcacatgtaaactaaaaatagctctaaggctaggattgaacctaaaaaagaacagaagaactgcaaacccgaaactgcttcaaggtatataagaaactaaaacagttaccaggtcacaaaataatgaccagtttacactgacatgcaactagcgattagcaggatgagcatccaaggacaccgtggtaaggacagcgtctgctaacgtttttattagttcaccgtcagatttcgtacaggtccgtatgactagaaagagccgtgttctgtctgcggctcacctttgattggtgaagcaacctcctttcttcccatgttggtttacggagctcgtgtctacattagaaaccacaaaagaatattaaaaatggtctgccgtgtgcttaagaaagaaaaagatgtattgaattgtgttctgattacaaaagtcatacaacttttttcttctctcagttggaaggtttcaaaaattgattctatccagagaatcaatccctacaaggctgtaggggcatgtgaactctcagacactgttggtgggtgggtccagtactccctttgcttagggcaattaagcagtaactgtcaggattagaaaagggtatacctgcaaagccagcaatcctgctaggaggcatatattcttaaaaaccactaatatacatgtccatgaaagggttctgcccggagatgttcatgataacatgatttgtaatgggaaaaagttgaaaagaatcacttagtaggagagttaatttaaaatgatggatccatgggttagaatactatacaaccattaaaattctttaagttgtatctttctatgaggacttggttggatgtccttgatccaaaaggtaaaataatcaaattgtacaaaatgcttgcacgagctctgtgcttctgtagactggaacaagcacgggaggaggcttggccagttacacagcaggctggccacacagtgacttctagaaggtggagttggagccaggcaaggggactgttctttttttcatcatttacttctggatgatttgaattttttagaaagaacagttattagttttgcaatttaaaacagactaaaataccatttttaattataaaaagctttaagagtcgatacgctgttgggaggcatcacacgcagaacccagtttatttcacacagcccttaaagctacagtggggatttccgtttggcggctccgcagagcatggggatcttgttttgccctgagagcatctgctcctctagggtggatgcggaagctgcactgcccgtcatcagatctgcggctgtgcagctggggtttcagtgcaccattagaaactcaggcagtgaaggagcgacttgagatggccatagtccccacgcagggttccctcccagcactggggttgccctgcctgcatggcttccggtcccgcttttctcactatgcagtgaacattgagcatcctgtcatagattctcccacaaaaatgactttttctgttttgttttgtttttctcctctgagaatgacactctgtgtgacattctttatataaacctgcagcaggcagagcctgagaagtcccctcgtgccaccctcagctcagttcatccttggctcatcctcggctcatcctcagctcatccctggctcatccccagctcatcctcagttcagttcagctcatcctcatccccagctcatccccagcgcatcctcaactcatccccagctcatcctcaactcatccccagctgctcctcagctcatccccagctcagctcatccccagctcatgcccagctcatccccagctcatgcccagctcatccccagctcatcctcagctcatccccagctcatcctcagctcagctcatccccagctcatcctcagctcatcccctgctcatccttagctcatcttcagctcatccccagctcagctcagctcatcctcagctcatcctcagctcatccccagctcatcctcagctcatccccagctcagctcagctcattctcagctcatccccagctcatcctcagctcatcctcatccccagctcatcctcagctcatccccagctcatccccagctcatccccagctcatccccagctcatcctcagctcatcttcagcttatccacttcagtctgctgtgggcttcacccgcctcaggaggacagctggctccaccccagctgcagcttctaaaatgggtgcttcctgttctttcctggaaagttcagaaggaaagcaaatggataggtcgattcccctccaggaagaccagaatagaataagtcgttggttttggatggaagctgcgtgaagaacacacttggtgggtggaagtgggagacgtagcttctctgactttgtttccactcagccaccaccagctggactctggtgctcgcagtctccgaggcagcaggacagcttcctcccacagctggggcagggaccgtgcagtgccattctgctcacctttctccacacttggctgtagtgccagcgcctgtctggtaaattactgctgagtgttaaacagtcaggggtcaggtttatcagccaagtcagacaggcttgttttagagaacactgtgattattcagtgttgtttaaattaaatacgtggttattctaaccgtgcattcttagagagtttcatcctggttttgcttggctgcacgtgcagagggtcctgtgggcagttccttcggcctcaagcgtatgggaaatattgctctggtaaaagccgcagcctggttccacctccgcctgcagacagctggaaagagcaccactcccaccttggaaataagaaaagggcagaaaagctataaaattctgacttttcctgaactcatcagagagctgaggtggcaggggaagtgagttgcccagcagggaagggaagaggtgcctccaaggagagccggaccatgagcaccagttccctgcagcagagcagaaggggccagcagggagaaatgctcacctgaaattggcagtggtttgcgcaaggctaaacctggaccaatggagaatctcaaacctttgggagccacaggctgcacaggccatggacgtccactgggccctcacccagaagattgaggtgggacacgagaagagcccctcagaggtgtgggcccgcagcaggctctcctgtgctgctccccacagaacataacctgcagctcctgatgaaagacagcaaaccctgtcgcccccagagcacaggcgaagacccactgccacagaagaactgcaaaagaaaaccttccatctccagcagggcgaggacctgccacgtgtggcacactgcagggagcaggacagagtcactgagaaggttccaccctgagacccagagacacaggccctgcctcagtcagagtctgggctagagcaacagagagcccttcggacccttccaacaggctagcaggctccaggcagcaggcacagcagtcgagctgtagcaggggcacaggagcatagagagagaagccccccaaggtgcagacacacgaggaaagccaaaaaccaagggagggtggggtgggaaccctggcaaaaaccctcccgaaacccaggccctgcttgaagcatgaggtagtgtgagaggaatccgaagctggccacatgctgagtgtcaccatggcaacagtaaaacccaagcccatttcagtgcctcgctagattgactgaactctttaacagtctagtaatagaggcacacccatttccaggcatgcatatatatatatatatatacaccttagtctctgctgttctacacatgaagtctggaattcattcagaaattaggagaggctgggcatggtggctcacacctgttatcccagcactttggaaggccaagacaagaggatcacttgagcccaggagttcaagactagccttggcaacgcagcaagacctcatgtctactaaaaagaacaaaggaaaagtatgagatgcccccaaaaatataagacaaacacgcctgccatcaagagacaaagcagagaaagacccaagggcaacccagatgttggaactatcagagatggagtggaaataaccaagattaatatgacctaaaggcattgacagcaaaggtagacaacaaacatgaacagatgagggatttcagcagagagttggacactaagaaagagtcaagtgaatgccccccagaggcctatctgtgacctcaaatagccaaggaaaaaaatcagtgaatttaaagacaggtctatagaaagtacccaaaatgaagcacaaagactacaaagagtgggaaaaaaacaaacaggattgcagatcatctgagagcttcaggacagtacaaagcagtccaacatctaaccacagatccagcaaagatcccaaatcatggtatatacagacacacacatgcacgtgcacacacacatatacacacacagctggacacatatctaagccaccacaaaccaaagataaagagaaaaccttgaagacctctggagcaaaaggacacattacttacaggggaacaaggacaagaatcaccacagacttctcattagaaactgtgtaagacagagatagtccagtaatatctttaaagtgctgaaagaaactgtcaacctagaattctgtacacacaaaaatatctttcccaaaagaaggtaacaagacaaacatatcctctcttgccacttgtcttcaacactgaactggaaattatagccagggaagttaggcgagcaaaagaaataaaacatatcatattggaaagaagaataaagccatctctgttcacagatgacatgatcctgaatattgaaaatcattcaaaatccattttaatagagtatcagaacttaaaaaccaatgcagcagtattgtacccacaagctcaatatccagtaaccatttgtatcagaatcccctacactagtaatgaaaaccctaaaaatgcaatcaagaaaacactttcatttataatcatagcaaaaataataaaatgcttaagaataaacctagtaaaagaaatgtaagacttgtactgaaacattattgaatgatactaaagaagacttaaataaagggaaagaaatcacacattcataggtcagaagactaacattaagttggcagaactccccaaatagctctacagattcagcaccatccctggcagccttttttgcaaaaattgacaagctgatactaaaatttgtatggcaatataagggacccagaataacaaaagaaaaatgtaagagacaaacatactgaacaactcacgcttcctgatttcaaaacttactacatagctgcactaattaagataccatggcattggcttaagagcagacatataggtcaatggatttgaattgagagcccagaaatataccttccgtcactgctttatgcctataaactctacaatttaggcgagatagacaaattccttggaagagattactacccagcgtcatttgatagcaaagagataacctgaatagttcctgtctattaaagaaaatgaagttttcttgctttgttttgtttgagatggggtctcattctgttgcccaggctggggttcagcggtgcaataccttccatcactactttatgtccataaaactctaaaatttagatgaaatagacaaattccttggaagagattactaccaaacgtcattcagtagcaaagagataacctgaatagttcctgtctattaaaggaaatgaagttttcttgctttgttttgtttcagatggggtctcattctgttgcccaggctggggttcagcggtgcaataccttccatcactactttatgtgcataaactctaaaatttagatgaaatagacaaattccttggaagagattactaccaaacgtcattcaatagcaaagagataacctgaatagttcctgtctattaaagaaaatgaagttttcttgttttgttttgtttgagatggggtctcattctgttgcccaggctggggttcagcggtgtgatcattgatctttgcaacctcaatctcctggactcgagagaccctcccacctcttcctccccaggagctgggactacaggcatgcaccaccagacacagcgaattttgaaattgtttacagagatggggactcgctatgttgctcagactggtctcaaacttctgggctcaagcagccacctcagcctctcaaagtgctgggattatggatgtgagccactgcatctagccaagaaaatgagtttttaactaaaaactcaacacagaaaacttctgacccagaaagtttcgctggcaactgtaccaaacctttaaggaggaaataataccacttctgcacaacctgtcacagaaaattaaaaggagtgaacacttcccaactcagtatatgaaggcagcatttttctgatatcaaaaccaaagatatcacaagaataaaaaacacagattcccaagtcctcagcatcgtattaacaagctccagccaggcacagtggctcatgcctgtaatccagcactttaggaggccaaggcaaggaggatcgcttgagtccaagagttcaagaccagcctgggcagcactgcaagaccctgtctcaaaaaaaaaaaaaaaggcattatacaaaaatcagttgtatttccatatgagcaattggacattgaaatttaacatcagtaccattcaaaatagcaccaaaatacatgaaatacttaagtataaatcttttttcaaaatatgtgaaagatatgtattctgaaaaatataaaacactgatgaaagaaatgaaaaggtctaagtaaatggagaccatgctcctggtttagaagactcaataatattaagattccagttctccctaaattgatacatagatcaatgcaaccccaatcaaaaccccaataggattttttttggtaaaaatagagaagtttattctaaaatttatggggaaaaggaaactaaaataaccagaacaattttgaactagaagaacaaagttagaagcctcacactatcttatttcaagacttgctataaaaaaagtaatcaagatggtgtgggattggtgaaaggttagatgcgtagatcaatggaacagaatagagagcccagaaattggtctacacaaatatgttcaattgattttcaacaaaggtgcaaaaacaattcaattcaatggagaaaggatactcttttcaaccattggtactggagcaattaacaaccagttgtcaaaaaaaataaaaagaagaacctcgatcagtacttcacaccttatacaacaattaactcagagtgaatcatagccctaagtgtgaaacctaaaactataaaacttctagaaggaaacagaaaaaaaaatatttctgaccttgtaggttaggcaatgtcttctttaataagatgcaaaaagtacaagtcaaaaaagaaaaaaacgataagttgggcttcatcaaaattaaaaactgctttttaaagacagttaagaaaatgaaaagacaagtcacagacagagcgaaaattataaaacacgtaagattaagatcttgtggctgttatacataaccctcaaaattccatgataaaggaaataagcagcccaattaaaaaacagtggcgaaagattttacagacaccccaccaaagaagatatacaggtggcaaataaggacatggaatgatgctcattgttaaggatcttaatcacgggaaagtacggacccctgcagtgagatcccactacacacctgttagaatgtctcgaatcttaaaatctaccaagtgttggcaagggacacggagcatctgaaaccctcattcttggctactgcaactacaagatgctacagacaccttggaaaaggttgtcagtttcttacaaagttaaacgtatgcctaccatgcaacctaaccattctactcctggatattcaccaagagaagtgaaaacatgttcattcagaaacctgtatgtgaatgtttatagtgactgtattcatagtcaccaaaaactggaaacaacccaagtttccttcacctcgtaaagagagaagctgatacaaccatacaatgaaagactcatcagaacaatatttaaataaactattgataaacgcagtggcacagatgcatctcaagtgtatcatgctaaatggaagaagctgctcaaaagactgtatcctgtatgatccatgtatacaacattccagggaaggcaaaactgtgtggaactgttctatatcttccacatttatcaaaactccgcctgtacctacagagggcgaaattcactgtacgtaagttacatcttcatcaacctcatgttgcggggagaagaaactcttttccctcttgtgctgaagtcacatgaaagatgatgtaaatgccttgttgaggagtgaacgtgcatagcaagctccgagcttcattcagagcttctcccccctccacagcttggcgatttgtggtaacacaaaggctgtgtccttggacgtaatgtacacgagacactggcagaatcaaatcacctctgttgcctgtggactcacgacgcacaccactacctcttccgcctcttcctctgctgcctctgtccacggaggggactttattgttcagtggggaggggatagtttgttgctaaaccgtggggaaaataataaaaagcgtcaaggggaaaagcacatcacagaggcaaatttgccctcacttcaggtcatcaggagctaagcgggtggagagggagggagctggcagtgtgagcgtttaatgtgttagcgatcttttcccatgggtgcctctccccttttgccttcacccaagtctttctcaatcttgatagtcatgtacctgttttgaattttatcccctgcaccttgaacctttctaaattcagagggattgaagataagactcagctctaaggctcccagattccccggataagaatttatcccaaaactgccccaaactgctgctttcccgtaagtcttctggggaacctctaatctccctttattcctgagccccaggtttttctttgcaacaggaaaggagttgtgtttcattggctttcagctgaagcctctgtgggaggcttcagaatcgtaattggtttctgtctgagtggaagccaagaggtacaggagtgtcaagatcctcatcatgtaacaggatcagcggcacccacagcctccaggagctctgtttacagggaggctcagcctgcactgggcctgggcccttttttactgaaaagcctttattcagcctgaagagaaacaggtggagaggaggcgacagagccgatgatgaagagctgcggtgtcatttgctgcctccgtgctgagcggcggtcacatcctagtttcccagggtgggtgcccgcatcttccacggcatctctgccttcccctggcctctccatccaccgctctccctcctgcctcacgccgcacctccacttctgcccatgcttgtcctgtgaccctcgtggtcatagctggttgtcctgacacagacacttggggtggttccggaaccgcgtcccgttcagaaagtctcttcccagcccagcaagggctgtaaaggaaggctgtgggctctctcctagagctcagattagggaagtggcggcccctacccctacaggcagaagcccctgggccgggagagggcccttgcagtgccgtggcaacaggacaagtgtggggccccctgaaacccctcagctcctgtctccgggcgtcctgtgcccctccctgttctggcatgggccccctctcaaccttgcagtcgtctttgttgtctttggagctgaggctctgaagccgccccatttctaccccccacgtctggattctttgcctgagctcaggcccaggaccatagagtgccgggccaaggagctggaattcccatcagttcctctcccttcccactcgaaagttccttctagactcttcctctaatttattcccagagaagcccgagtctcattaaagtgcaatgtctctgttcctgcacagctttgagtctttccaccgcgggttttttcttattactgttctatgttatttaccatttgtcatttcttttctaataagctcaggattgtcgtcaagtgaaactggttgctaagaatccacagtctatcccatttgccgttgcgggattatttctaaatcagaaaatgtgcggagggagccatttgacaccttttgtggttactgtttccgggtttggatgtcttttttgctgtgttgttgctgttttatcgagtgtggttttgtgacttttaagaagaaaaagaaggaagcagagcaatcaaatgctaggaactgagccacagccacccatgagcacggggtcagacatgaggtttggggcttgcctgtttctgttttgtaatcagagctgacacaaagcattcgaggaagagacacaaagaatgctctgtaagcatttgcacatgataaccacctacaacgaccgcctaaaactccacacggagaaaccgttttctttctccgccacatttacgtgcaaggacgcaaacacggccatgcgccatagtctttattcccatttcttctatcagagaaagcgactttttaataactaatgcaggctctctttttcctttgtcgagacagagttgcttttagccaaaaggaattagggttcttaccttgtttatttcatttattttatattttgggtcttcacaagtcttagtttcttagcaaggaacagaattagccagattgactggacggcatgtatgcttaaggaaatgcatctgcgtaacccagacaagtggccatcctcccgcggaaagtcaattaaatcctagttagtatttgccaagtgtggacctctcctagacgctgaacgtgcacaccccaacccacatgtgcgtgcacacacacagacacatgcacgcactcgcacacacgcacacacacgcatgcacgcaaaggccctgaagtgaatgaagacctttgctcagggaagagagggcagcagcatgtctagcgtctgcatatttcaagtgaaaataaacttggtctttctgaagctgtctcattagggaaggcactgaagttctcacgagttagtttaaccccagccaggcttgcagctcagcaccctcctagctcttccaccatcaggagcccagtggcaccccctctgctgcccaggaaggtcccacactctctcggggcccggcctggcctctcatgaggctgtcttccttctgtctcgtaagctccctcatcttccagccagctgcctggttccctttggcattagagagagaataaaggcagtgtctcctcaagcgcacctgcctcctgattgtgttttcagtgtttgaagcggcattcggtgcccccctgccctgctgctcagtgctgacctcagtgccccccattccctggggaggcgtttcccaaggccctggtccccatcatacacctgtcagcctcacaggccactcactcaagggtctcagagcccccacactagtgaacacaggcgtggagagcgcctctcccagctccggggagggaccagcgatgtgttttgtagcagacacaggacccacaacagcccgtgcctctggtgcactggccagacgagaagcccaaagccttcagcctttgagaaagaggtgccttcatctgaaaataactacagccaaccctccatgtccacaggtgctgcatccgcagattcaaccaattttggataaaaaaacaaatgtaaataacaaaaataaatttaaaataacaatacaacaagaaacaatccaaattttaaaaatacggcatagcagctatttacacagcgttgacactgtgtcgggtatggcgggcaagctagcgagggtttgaggtgtgccggaggatgtgttctgcttgtacgcagatgccacaccctttcgtattggggactgagccgcgcaggttttgctatccgaggggtcctagaacccataccccattgataccaagagacaaccctgtttcatcgctgggcttaactgggtgttttctgttgttgaagatcccagaagagcacgacctggagagtcagatccgcaaggagcgggagtggcggttcctgcgaaacagccgtgtcaggaggcaggcccagcaagtcattcagaagggtaagggcacccgcacagccagccaggggctcattccgggggtggggcctggggcgagggtcccctgtgagcaggccccccgcggcccacgcacaaccttctccagccatccactgtcccacgacagacccgccccgcaccccacctcccttgcagataagcacatcaaggctggtggagatgaagctgctgctcctcaaggttctgcagcccagagtggggaggggaggggccgggtgggaacccagccaccgcctgggaagagggctctcccgggaccctgcctcttcctctgcaagggcagccctcagccctcgggattatcagcgcaggtggaactcatggaggcggaactttgcatgttgacatttccggaagggaaggcctctgagagcccacatctccccacccggacaggtgtcgttgcgccaggccctacacatggcgcatccttccctggaaacaggaagtgaaaatgccaggccctgctttcctcagctggcctccacttgtccctgaaatggtggccagctctgtcaccccacatctcagtcatgattttcctaaaccttctcccagatttgccactagatgccaaatcgctcccttcacctaccttgttgtttgctctcccagctgcacccggggtggaggggcagggagcagccctggagggggcggtgtctgttgccgcagacagcggagggagctccttgcggaagggatccaggctgcaggcggccccggtcacagagactgtgtggggagcagggaggccctgagagtcaacacagcaatgagggtgtcaggcagccccatcccagggaccctggcctctccccaggatccaggagagtacaggggcccaggcccagccctacagccccactgagggcacggagcagcagtggtgtctccgcactcctccccctgccctcgcggccacaggctcccaccactgagccagctctggctgggggacctcaagctgcccccaaccaaatcagcaccatcaaaagtcaaggactctgaccccagtctgcaggtttattgttttgaccttgcatctttgtcctgtaaaattctggagattattatgggttactttctgaagttgaggttgatgacccgtaggacagatgtcctccctcctgccaaagccgagggccctgcccgcaggcagcacaggcgccatgagcgcgtcctcagcgagcgtgcctaggcccggctcacacctctgctctgctgatcaccgaaaacactgctgacttctggtaccagcaacgtttctgaagcgcattcccacgcagctctctctgtgaaagactgcggttcatctcgcattaacgcagacggtggctgttgtgctgaaagctaattgtggttgtttgtagccctctgtgcatctgaagagctggcggcagaccaggtttaaagcatcgcatgttgcaatccggtgcgtgctgccccggcggccgccgctgaaccttgcagccagggtggctttctccagcagagagaacagaccctgctggatgagcgtctccaggtggcggcgacaggaggctgttttcctggaggttagcgattctctaggaccccagcctgctagctgggatggccagcacacgggggctgcctgctgcctgagacaggcttgggagctgagtctgcctcacacagttcaacatctgaagatgagctggcccctgatggccaaggtgatgctctggcctggagcctgtggtcagaattgagcagggtgcgaaacagagccggcattcgagacccaaaaccgagatttctagaccaaaaaaaagaatatatttgtaaaccagagtttgtccagacacacaaaggaggagctgctgagccgctggagacaccaccaaatgaggcctcaagacacaggggatggtgccagcaggcgtggtgccagcaggcgtagtgccgggagtcactgaggagtgaggccgcgccctcctcccagtcctctgtcctcggaattcggattcggtgcaggcgtttattttcatttaaggagccaactgtgtgctgggaaagatgtgagcattgagaaaaaggaggaattgatgcctgtagatggaagagaaccagagaagtcggcgtcgcccaggagacggggttgggaaagccctgtgtcacgcaggcccctgcccggctcttcagccttctcctgggcaacattcacgaccttggctgtcacgcactgattttcaaacgtaccaaatgcgtgggctgggtggggtttccctttgtccttcagtgcttagaattatgcccaaactccgtccagaactccctgcagctgggaatggaggcaccactagggtaacacggtgctgccgccgcaccaaagccttcgggcctgcctgcctctgtgagtgcagcctctccttgtataacgtggcattcatttcctttccgtggttctgggtgtttgctggggactgacattgttggaaacagtagctcacccgaggtgccgagcacacaccaggcatcagtgaggcttcagcccgcagactccgtggccctggtgccacctggacagtgccaggcacaagcggaggggctgtcagctgctggaggtgggcggctttggctgtgcttaagcccagttcagagcagcctgcagcagagtgcccaagtcgcgcggctttgaccttgcaccccgacggtaggctccttctgttgtaggactttttaattcagctaaaaacagggtctttgtcacatgaccatgaaaaattaggctcccagacactttgaagggtgggaagggcagggtttattgggtgagaaggaaaaaacgggaaacagggcctccccgcaaagccggagtcctgctggtgcacttcccgcctcgcagattggatcccaggttctaccccagatcgggaggctgggctcctcctgctgcaaagggcgccaacttctgtggctccccccgttgtcccagtgtgcaggctggtgggagtttctctggggacccctttatacttggctatctcacttcctgccagagcacaagcccaccactccccacagggaagactggaggcgggcaacggtcctctgagccagaccagaagttcaggtgaggacacggttagtaagagccagtcaggtgaggacacggttagtaagagccagtcaggtgaggacacggttagtaagagccagtcaggtgaggacacggttagtaagagccaggcggtgtctctctgcaccacctggagctatgtctctggctgaggaaggcttgggggtccccaagacaccctcctggttgcccagaggccacacaggtgaccgcagccaaggccaggaggcagcccagcttgtgtccttggtgccacaacagacaatgaggcttatgcacccacagatccccagctgccctttcagtcaccaggatgtgttggaatccatcttgcgccctctgcatttttagcttccttttatggttccttctagaaaaaagccttttagagtcacaagggacttacttcctagtgctcgtgtttgggggcctggtggttaagtccacgttcccctcttctgttaaatctgtgattctgtaatagatccctcagtcaaggaagttcatagttaccattctagactgaaagacccccggactttggctgcaatgtggatcctggcgaccacacccatgtctcctccttaagtctgttacgaatcagagccctaccgagcttattctgaaactttagcactttcttcatataatctgacccagataaatttgtacaaacctgaccactgctgacaagtattggctgaatgcttccacatgtccagctcggcatcaggagctttgggggttttgagcaaaggcattaaccctgcggccagggcccctgggccctcattctgggtactcagtggctgccgtcaccccaagagcccagatgtgcctgctcctcagcaggtggtcaggcccctcccttcagtccctgcttttcttctgcttcctttgtgcctctccaagtccccaaggtattgacgtcggccatgataagatacgtcgtgaatatttattgtaaattaagactggcttgccgggcatggtggctcacttctgtaatcccagcactttgagaagccaaggtggatggatcacttgaggtcaggagtttgagaccagcctggccaacatggtgaaaccccgtctctactaaaaatacaaaaattagctgggcgtggtggcggatgcctgtaatcccagcgactcaggaggctgaggcaggagaatcgcttgaacccaggaggcagaggtggcagtgagccaagatcacaccactgcacttcagcctgggtgacagagcaagactccatctcaaaaaaaaaaaaaaaaaagactggctactggctgggcgtatgcccataatcccaacacttgaggaggccgaggcgggaggatcgctcgagcccaggaatttgagactaccccgggcaacacagtaagaccctgtctcaacaaaaaacaaaaaaaagtagccaggtgtggcggtgcgcgcctatgtccccagctacatgcagagttgaggcgggaggatcacttgagcaggaggtggaagctgcagtgagccatgatcacaccactctgcaccccagccagggcgacagaacaggacactgtctttaaaaaataaaaaaggggcccggcgcggtggctcacgcctgtaatcccagcactttgggaggccgaggcgggcagatcacaaggtcaggagatcaagaccatcctgtctaacacggtgaaaccccatctctactaaaaatacaaaaaattagctgggcatggtggcgggcacctgtagtcccagctactcaggaggctgaggcaggagaatggtgtgaacctgggaggcggagcttgcagtgagccaagattgcaccactgcactccagcctgggcgacagagcgagactccgtctcaaaaaaaataaataaataaataagggggaaaagatgctggctcctggatccactcttgtgtgtttcttttgacaggcattacgagattggacgaccaaatatttctgaacaggaaccccggcgtcccctctgtggtgaaattccaccccttcacgccgtgcatcgccgtagccgacaaggacagcatctggtatgcaccgcgctggtcaggcctcccttccggctgaccgacagccccagcgatgccctgttctcccccgatcaccactcctcttccttgaaaagcagatacaaggcactcaccccgaggcccttagcactgtttcctgagaaacggccctactcaccttctcctctttgaccgagccccacccacacctgccccgggcctggccctgtccttgtcactgaaggacagtccagagtcctgcctgcaggtcagaggggagtggcagggactccccagtgacacttgtaatagaggcgtacacaggggggccagcttgctgccctgcccgcagaagcaagcatgtgatagacaagcagtaagaagatgctaggtgccccaggagagaagtgagtttaactcacagcaaatatcgcccttagagatggagagagtacccacttcatgggggagggcagtgggagggggttccttttagagtttagagtttataaaatctctgtggttcacacctccatttctttttcctctttttaaaaattgtggtaaaacatacatagcctaaaatttgccattttaaccgttctgagtgcgcagccagtggcattcagcgtattcacattgttatgcaaccatcacccccattggtctccagaaccttctcatcacacaaaaccaaaacttggtccccatcagacaccagctccccattcctgcatccgcctgagccagtgtttcactttctgtctctctgaagtggcgcacgctaggagcctcataccagtggagtcacccgggatttggccctttgtgcctggcttattcggctcagcgcagtgtctttaaggttcctccaagctacagcacgtcagaatttccttttcatggctgagtaatattccactgtgtggatggaccacactttgtcttatcattcatctgttcatggacacctgggttgcctccaccttttgtctattgtgaataacactgctgtgaacattggtgtacaagtatctgttcaagttcctgctttctgttttttggggatacgcccagagtggaattgctggaccatatggtgatgctctgtttaattttcggaggaaccaccaggctgttttctgcaggaaatcctcttcccttcccacccgcacagcctgtggctccaatttcccacatccttgccagcactattattctctctttgtttgtttgtttggagacaaggtctcactttgttgtccaggctggtcttgaactcccaggctccaacagtcctcctgcttcagcctcccaagtagctaggatgacaggtgtgagccgccgtgcccggctgtggtgtgtggttttttgatagcagcccggtgggtttcaggaggtatctcactgtcatttgggtttgcagtttcctaatgacttttttattcctctcttcttcccttaagcttttgggactgggagaaaggggagaagctggattatttccacaatgggaaccctcggtacacgagggtcactgccatggagtatctgaacggccaggactgctcgcttctgctgacggccacaggtgagcggggtttgcacagccaggattggaagccagggtctggaggagtggcggggagggtgtgtgatcctgagatgtgtttgtacatctgtcttacagaaagccctgctcacacgcgagggccactgtcattcagaagtggggaggtttatgagggaaagggcttcagcagcagagacaggaaagcaaagatgaccccatccttgagggttccagggacttgtcttctcatctcagtcctctagcccttccagcaccaggaaaagcctctgacagcctctgtccttaaacccctgtgagagacccggtgggtcccacgtgacacccgagaatcagggaaggatgccccaagccacaacacgtgccaggtcctccccggccagggtctcctggcatcgctggctcatttgccagttgctgtccccactgggagctggcactcaccctcctccagtcccgtcctgcacctgaaaggacatcgttgaccatcatggtcgctgaccagtggttcattgccgtagtgggtctcactcaggttttggttttcttgggttttcggggggttttttggaggggtccgaaatgtcttagtttcatcttcactttggaacaatcgtttgtttccatgtcagttaccccacgttgacagtcattttcctttagcgctttgaaaacacgtgtccattgcctgttgctgatgagaagtcgctgtcagtcccactgcacttcctgtggagactagagagcgctgggcgggaggcaggcgggggaggccagcacggctgagagaagtgaaggccgacacccggatcccacccagcctgtccctgtcggccgcagcccctggacacctgagcctctgagagtgtcgagtcggttgtgctgacaagtgcgcagccctctcaacgcggttgcgggctcctggtgaggggcgtggccatggggacgtgtcctcgtgcagcccctcctccgagcgctgccccctcaggaccaagtagcatcaaccgatgtcgaaagcccgtctttgtccctgtagctgtcagacgtgaccgggaggagatgcatagtcggggcaggggccggtgggggcaagggaccagccaggctcagccagcggtttcggagagaccagatgtgagcatctcccaacaccagagggagagggcagttccttggctgagagagcgagcactggagcagggccagggtcctttgcagaacgggctccagacagcagtagaagggctccagctccaaaaccaggaacgtttggtgtatgcgatggaaagcagagagcgggacaggcaggtgggtggaggtgaggccgtcgtccaccagggcaatcagctggggcttgaagagcgcctgagggtcacgcaggaggggctggtgaggccagggggtgcggatgtggttcccggaaggctcagagtgcccgcatgctttccccacacccaggccgacctccctgcctgtctgctggaggatgcagagggccgtttcctccattctaagccctgaagagcagggcagtgcgtccctgcccacgtcttaggcggagagcccagacgtctgcattgtcccttcaagtcaaggctactctctctgtggagcacagagaggaatggggcggagggtgctggtgtcctctgtgaagctggcctttcgttctgctccctggcacaggctggctcaccagagggtaaaacgcagccccacccacccaaccgagcttcacccgcctgcctccctccagggaacccgatgccctggagctggagggaggaagggcagccccggctcccagggcagccaaacctcagagttgagctctgtggccagggtgggacaggattgtggtctcccatcccctgggctgcgactcctcctgctggctcgcccagatatggatctgaggacagagtccagtcggtgggcacccagagatctggaaccacgggtagtgagtcaggctggccgcccagggtcactgcagcacgtctgccaggaagggctcttaccaccacgcacagagcacaggccaggccatcgaggggcctggttcacatcctttcctctctccctccccagacgatggtgccatcagggtctggaagaattttgctgatttggaaaagaacccagagatggtgaccgcgtggcaggggctctcggacatgctgccaacgacgcgaggtgggtccgcccggctcctccccagagcagaatgtgttcccggggctgcggacgcactcggaattccaaggcccttctggggctgtctctaaacaggctgctccacctcagagtccccagaatcctaaagcaacagctccccgccaatgtccccgaaagcgtgagagccccaggtccctgagtgcactgcctggctggagtcccagccctgggcatggtctcagccactcgtgggtgcccctgtccccaaccttcatccttggcttgcagacatgtgctgcttgggacagcatcactgctggcagggcctaaagggcccgcatcacggggtccttctttggacctaaaattaggtctgctctttggacctaaatttaactcctccttgggggtcggggtgcacatggccatctggggcctcacgcgctcgctggcatgcctgggctggtgggacggagtggctgcagtgccggctctgggtacagttctgcgtgttgcctgcaccgctgcacggcctgggtgcggggcgaggcgcaggcccacaggtccttctggaaggactcaggcaggagttaggaggctcccggggtcaggcttctgggtctagatttccagaggcccctctgcagcaccaggcattcgcctctaggagtcatcgctcttcagcggatcctgcagcccttggcgatgctcagagtgaacgcgttaccccgccagcccccctctgccggctcctgccggtttgtgatttctgtgtcttcgtctgtggcctgtggatgtggccttacacctcgtggtcagccttccgtgtggggcctgccctggttctgccctaggttgcatggctctgtctccgcccttctgtctgagcacctgtcccgggagatgccaaccctcacgtgcctcgggacgtcatgggggcagctccagggtggacattgcctcgaacgttggatttttttttttaatgtagccatgttcttaagtttcatccagcaaaaaaaatcatccacaccccgcactccgtgggggccctttcctgttgcttctgtcctgatctctgggctctgcttcccctgcgaggcaaccctcttctggggtatgacagcttccctgggacagggcaggaaaagtgagccccagcccggggccctggtccaggaggggtcccgggagacagctggatggccagcctgggggtcaggccactcaccggccattgtgtgtctctccaaaagaccaattttggtgacactgtgtcatttgctagagaggaaagatcactgtttgataggctttccaggctgtttttctggggtcgctcagaggcagtggtgccatggaaggagctgggcttcagcacgggagcgcctggctgagccctggctctgccttgccctttctcttgtttgcttttgtgaaaacttccctccctgtccaaggctcggacctgccggaaatgcagtgctggaaggacacacccgtggctagccccggggtccatgagacccccctagaagcatccacatgtccatgcccagctggccccggggtccctgagaccccccggaagcatccacacgtccacacccggctggccccagggtccctgagaccccccagaagcatccacacgtccacacccggctgggcctggggtccctgacacccccagaagcatccacacatccacaccgggccacgctgcaggaaacaagacttggtggcctgtgctgccccacgggctctcagtctctccgggtcaggatggcagtgcccagcttacatatcaggaagcagcactgacgagaaaagcggccttctcggcccagaccctccagtgcttccttcagagtgggagcctgtgctgcacttcaggggtctcggggtcagagaacgaggctctcactgcgggggaaggcagcagaggcgtctcgccagacgtaagagctccaggccccagtccccgaaggctgtgccagctgtgggctggggcaccaggcacagctctgggctccctcaggttgcacaggacatgggaaacctgggtgtgggcagcaggcgggtgtgtcactgctgctgcggctttgctatgtgtccaggactggttcaaaccagttcactcggcatcacagaatctgaactgaaaaaggacttagggttcacctgactatacccctccatggcaggacgctcgggccgagggacagctgcccagagcctctggttcagatggacacctgaggcccagggtcgggctgtgccatgtcccccatgccggcatgtcactgtcctacccgggtacgtcggcctatgtgctggagacagggcctttacagaggtgattaaggtcaaaccaagtcaccagggtggccctaacccaatgtgcctcgtgtccttacaagaagaggccaccaggacacagacacacgtgcagggacaggtgggcgttcctgggacgccggctcggcactcacccaatgaggtcacggtgtcaagggagggcccgagttccagcaggttgctgggggatgtctcacgggcctgagggtaattatttgtcatcgattggagtcacactgcctaaatccagagccgtgaatgctgaccacagcacagccaccactcttcttgaaagtcacagtcaccaggacccagtgttggcatttgatagattaatggtattagcaggttggtttccctccgcggtattacatttaagggaataaacaactcacatgaacggccaagggctgaagacagaagtggtgctctccatcttcgtcaggtgctcacggagggcccacagcacatctgatctggtcaccacggggatccgtggagccgcagaggtttcatcctcccctggaactgaggagctcaggccctccgccagcttctgctgcagggagcctgcaggaggcccaaggcgtgacctccgcttgccccagcccccactcgcctctcccggacccgcttgcccagttgggcacacccagctcaggcacacgcaagccaggctccccacgtcacccctgagactggtgctttggaggctgtttcttgttttctggcatcttgaatgttctccatgtgctcgttctcaccttttccctctgtttgttctgctcgtgtcactgctgttcccagggcacctctctgttcttcccgacccaaggtgtcgcttcctggcagagtcaccaggaggatcgtgcctgggacgtggctgctgccccccaagtgaccatgcagtctagaagtgcagagcccagacccatgcatctctcccttctctttttcttttcttctttttttttttttttttttttttttttgaggtggagtctcgctctgttgcccaggctggagtgcagtggcgtgatcttggctcactgcaacctccgcctcccaggttcaagcgattctcctgcctcagcctcccaagtagctgggactagagggtcgcaccaccacgcctggctaatttttgtatttttagtagagatggggtttcaccatgttggccaggatggtctcgatctcctgacctcaggtgatcctcccaccttggcctcccacagtgctgggattacaggtgtgagccactgcacccagcctgtgcattttccaagttgtgcagccaccacctttatctagttccagaagattctcaccactccagaaggcggcctgctgcccattaaagcagtttcttcccatagattcttatttatctatttttgagacaggttcttgctgtcacccaggctggaatgcagtggcaccatcacggctcactgcagcctcgacctctcagggctcaggcagtcctcctacctcagcctcctgagtagctgggaccacaggcccatgccccacacccagctcccataagttcctcacttaaacagagagaaacttagaaaatgtctgtgccaagccaagccctctgtgcttgtggatctgccccaggtctcagagtggggcctcagggcctcctggcgcagcctccggatggccgtgcctccaggcaggacagcactgagccactaaaagggatgcaccaggaaccctgggcggtgtcctcctcggtcacccagacgccacttcccaagagcatgtccgggtgggcagcaagcattctttgtgattaatgtaggtaacagcatatcctgagggagggggctccagttctgtgtcctcaggctctgttggctgcacagctgcagcaggagctgggctcttctgggcagaaacggggaagtatgtgccctcccgcccggttgcacaccggccctcactgtgctcacaaggcctcccagcggaggagcagggctgcaagttgaaagcctgtgatccaccacggcgctcgtgcttctgacctgctgggacatttcttcctgcctgggttcaggtgtatcacagtagagggactacacttctttttttgtttgtttgtgtttgtttttgagatggggtcttgctctcactgcagcctcaaccacctgggctcaagcggtcatcccacctcagcctcccaactagctggaccacaggcgcacaccactgcaacggctaatcttttttcttttgagacggagtttcactcttgttgcccaggctggcgtacaatggcggatcttggctcactgcaacctccacctctcaggttcaagcaattctcctgcctcagcctcccaagtagttgggattacaggcacccactgccacacccagctattttgtgtatttttagtagagacggtgtttcactatgttggccaggctggtctcgaactcctgacctcaggtgatccacccgcctcagcctcccaaagtgctgggattacaggcgtgagccactgtgcccgggctacattggctaatcttttattatttgtaaagacaaggtcttgctatgttgcccaggctggtcttgaactcctgggcttaagcaatcctctgtctcggcctcccaaagtgctgggatcacaggtgtaaacacatctggcctgggactgcatttcaaaagtaaaataaagaatgtatgtatgccagcaattaacaactagaaaatgtaattataaaacatcatgggccaggcgtggtggctcacgcctgtaatcccagaagccgaggcagatggatcacctgaggtcaatagttcaagaccagcctgaccaacatggtgaaaccccatctctactaaaaatacaaaaattagctggacatggtggcaggtgcctgtaatcccagttactcaggaggctgaggcaggagaatcacttgaacctgggaggcggaggttgcagtgagccaagatcacaccactgcactccagcctgggcaaaagtgtgagactacatctcaaaaaaaaagaaagaaagaaagaaagaaatcatagacaacgggaataaaaactgcaagatacctaggaatgaatccaacaaatgcactttcttcacagatcaaagcataaactctaattgaagactataaaaggcacatgcagtgttcatggcaccatagccatggatgaaaagactcatcattgtggagattggcagttctcaaattaatctgtggatttattaatacacttttgattatattcccaggagagatttttataaaatgcagaccagccaaggcaatattgaagaggcgcagacggcattaagaagctgcaattgcagggcagccaggccaagaggcaccagggccctcagcgcagcagtgagcccagaagggccgcaagtggcagggtacctctgcgcactagggaaggagccatgttgctaaatggtgttgggacagctgatgccatatagaaaaggatgcagtgatacccctacctcacaccatgcacaaaacacatcacagtgagagacctaacctgtaaaagcctttcagagaaaaatcaagaggaaatcttcctaacagtgaggaacaaaaagacagattgaacaagagattgagggtaaagacatcaataggtttgactctacagacttcttcatgaccacaagaaaaatgtcacggttgtaatgtaagtggcagaataagaaaagatatttgcagtatctacgagttacagaatatatataaaaatatgtgcaactgtctgtcgtgaaaaaaaacggcaaacaccacacatcgataaggatttggggacattggcttgtgtgtgtcctgccgagagtgtagatggtcacccatttggggaatgaaatggccttccctggggagatcagagtcatgcaggatacatgactggcagttccgttctaggcgcttccttctccacccgcaaggacacgtgaagttgttgactgtgacatggttcacaaagccaggggcagctcaaatgacggggttagttgtacagtggaaggtaacgcaagattaaatgagttaaccagagctgtgtgtcttgggccagataaatcctcaaagcctaacattaaagaagcaagttgctagaaaataggccccattttgacactgaagaggttttttgaaatgtggaaggcatgttacgttgttgatgagcgtgcgtaagcaggaaaacctcagcagcccctgggaggcgccctcagcccaagggacagccctcccaggcaggcgcaggggcagacgatgcttttactgtgtctaaaattatgcttctctatgaaaaaaaaaaaaaagagcaaacaatggtaaaatgttagcaaagttagagctgagtggtgggtacaaggattactatggtgttcctttctgtatcttaaaatggttatcattacagttttagaactgaatctggttttaaatacaggccgtcacgtgaggtgggggttgctctgctctgtctaatccccacacaaagggcagcccttgccccattctctccgtccatcccttgctgacgccagccgtcgggagtcagccccttgctgtctgaaggctgccggcccgtggcccatgccgagctcctgtttgtctcagaagaaccggcttcctcaagctttgatagggccaaaaggaggaccctcatcttcaagccttaacagccttcctaaagtcacccagacctgccagttctgcccaggcgtccagacggcaggcatcttagacgtcgctgcaagggtctgctccagatggtgagcaccttagacagacgttgctggaaggcactgctctgaacggtgggcacctaacagacgttccgggaaggcactgctccggatgttgggcatcttagatgttcctggaaggcactgctctggacagtggacaccttagacagatgttcctggaaggctctgctccgatgttcctggaaggctctgctccgaacagtgggcaccttagacagacgttcctggaaggctctgctccgaacagtggacaccttagacagatgttcctggaaggctctgctccctctagcgatgcctggggcatagtcgagtcaggggaagactcagagttccagctcagaattgtcgccccagcctggacttgggagttccagctcagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccagcctggacttgggagttccagctcagaattgtcatcccggcccggacttgggagttccagctcagaattgtcaccccagcctggacgtggggcacaccagggtccctagcgggagctcatatgaggcatatggacccaccagatgggctcgatggtggcaggggtaccttgtagctgctggccaaattgctgcccagagcaggccccaaagcctgcccaaggcaagggcccatggggtgatgccatgtcccactgtatctctccaggagctgggatggtggtggactgggagcaggagaccggcctcctcatgagctcaggagacgtgcggatcgtccggatctgggacacagaccgtgagatgaaggtgcaggtaaccatgcaggtgtcccccaagccctgggcctgtggggcagtgtgtgcagggctggtcctcgtcacagaacccagcaaagtgtgcggtgaggcctggccatcccaggggtggagtcagggcctgggaggacagtgccgggacaatgctgggaggagacgtgggctccctgaggcctctggatgaaggtgaactgcaacacccagccctgcgctgcagtatggctcaggctgcgccagctctgagtgtttgcaagtagtgtcttctctctgcaaattaaggaatgtcagaaatcagtagggtgaccaattgtaaattagaatgattaattatttggaggcgtttttttttttcttttgagatggggtctcactctgtcaccctgcgtcacccaggctggagtgcagtcgtgcaatcacagctcactgcagcctcaacctcctggtccaagtgatcctcccacctcaccccccccccccaccaccaagtagctgggactacaggcatgcacccacacgcctggctaatttttttaactttttgtagaaacaggggtctcagtatttgcccaagctggtctcgaattcctggctccggcaatcttcctgccttggcctcccaaagcactgggattataggtgtgagccgctacagaagacagaagatttttgtttctttttttttttttttttttttttgagacagagtcttgccttgtcgcccaggctggagtgcagtggcgcgatctcggctcactgcaagctccgcctcctgggttcatgccattcttctgcctcagcctcccgagtagctgggactacaagcgcccaccaccacgcccagctaattttttttttgtatttttagtggagacggcgtttcacgtgttagccagaatggtctctatctcctgacctcgtgatccgcccacctcagcctcccaaagtgctgggattacaggcgtgagccactgcgcccggccagaagcctctttgcttcttaaagcatctgctattttcagttttgacaaaaagcggagtacattggttttgcccaagacagcctggaaaagtggtagagacctaagcaggccgcgctcagcagaaatctaactgcattgacttcatttggagcagaggcgagaccacagatactgtgaggggcagcgcctgaggtggctttagagccagtattcccttcctctgggtccccagggagaggtgtggcacagaggccatacccagcctctctcccgggcaggccatctggtgtcaggagggatggctcagccctgctgccgtagagggcggtgtggagcaggcccagcagaggggaggcctgggcaccctcagctgctcgaagctgctgtggttgctctgggcagcagcagcccgagaacctggcccaggccttcccgtgtgggcagcctcccctctgacgtgaccgtggatccctcgaggcaccagcagctttcatggcaccttctttggggtgggggggtcttgcacctgtctggagctgtggctccacacgagacgtagccctcagggcacagcgtggacaccctgatcctcagggtctggtcaccagtgggggcttagaggcccaggtggcctgcggggcaggtgctgttcctgcagaggtgggtggaggcacagagcgcagcaggtgctcccagagccggctctgcccctcgcaggggtctggccccatcatccccacgcctgtgtttcctcctggagtgcacaacccagcaccgcccatcgtgcgtggaaagcgctctccctctcgtggcccttttcctcctgcgtccctggcaggtgccatcgcccccgcccccgcttctccagcacttagagcccccgagggagccagatgacccctcctggactcatcccatagctcattagaagttctgagacgcagccagtgaggagtccttgccaaaatgtgctttgctttcctttttaggaaacagagagaggttggaagtttaattggcactgacagccagtccttcccagaggcgtttgcaggcctccgctcggggtggggctggcctctgcctcactggctgggtcccaggcgcctcagggcctcagggctgtccctccagggccaagggataagggcgtgactcattgtcctgccagcccctgcctctccctgggactcctgggctccccaggcctttgatgcttccctggatagagagaaaggcccctgcagccagggagggtgatccccacagccaggcaggcagcaagaggggtcctggcgctgcaggacagcagggagggtggctcggtgccccggtcttcaccgggctgcctgtgtttggctctaggacatccctacgggcgcagacagctgtgtgacgagtctgtcctgtgattcccaccgctcactcatcgtggctggcctcggtgacggctccatccgcgtctacgacagaaggatggcactcagcgaatggtaccttgaccctgtcctctccctccccgagtgctggcagggtaccttccaggtggtagggccgtgtcactgccatttggttgggtccaggtttctcagtgagatgcaaagcttccccaggagcctgcagtggcgtatttaggccagtcctgggctccccaaagccgccaggcccgtcccactgaggcccatcccacaaaggtctgccccacagaggtccaccccacagcctatggaggagcacaggggacaggccatgtgggatgagccagtggactggaggcagaggctgtcggggtgaggcagggccgcagccaggcacctgccacctctgagctcacctgaacagaatactgccactgcctgccacctcctgggtcatgcagcaagtgtctggggagggatgtctgagggcacacacgtgggcacagcagccctgggcactgcctccactgagcacccctgtgggcaggtgctgtccgcgtctggcagaggacagggtacacgcatgggcacagcagccctgggcactgcctccactgagcacccctgtgggcaggtgctgtccatgtctggcaggggacagggcacacgcgtgggcacagcagccccgggcactgcctctgctgagcacccccgtgggcaggtgctgtccgggcctagcaggggacagtccgtcttggcccacacggctcatgcagcagaagtaaatttcacccagcacagagcgaggattcccagaaggtccttgtgcctccagcttcatcagctttaggtctgggattctcattcctgaccctccagtctgcacagatcggggagacacaatgaggagttttgagggaagcaaagcaaagggtgggcagggcctgggagcgctgcgatggccgcctggcccccgtctctgggcagcttccatgtggctcagacagtcctccagcggcctgacggtgacctagggcccagccctgagccagcctggggaggacacagggggtctctgctggagcaggtcacctggagggggctctgaccctgcgtgagcactagcccctcgtggggagcggacgggcgagggcctgcggacccgctggcacaggcagacctgggcagctcccggtgagagccccgaagggtggggacgtccttcagggaagccccacgctgagcgtgccccctcccctacagccgcgtcatgacgtaccgggagcacacagcctgggtggtgaaggcctccctgcagaagcgtcccgacggccacatcgtgagtgtgaggtgaggagcgccgatatttagcagccgttctgctgtaaaaacattattttcccctccatttaaaatacgtccttggtatttaaacagctggaaggggatggcatttcgggcagtaattaactcctgccctggaactggccagaaagatcaggcgcagcccgtaggggcccaggggccacagctgctcccctgctgggggacacctgacctgcaggcgctttgggaactttcctgggctgccaactgcggagggttccggggggagttgggcagctgctctccctccacgggcaggggtggcagggtggcaggggcggcgcgtctgccaggcacgtggcagttgtctgcacataaattcagttctgcctcttggtaaatacagcaccaagagcagggaatatttatttgcctattaaaggaagagcaagatgtaatttatgaatgcaaagccagcatttcttcaaagagatgctcttttcccccttgtttgtgatataaaaaccaaacataactcttgggatggacgcctgctgggggtggaaggcaggagccacggggcctcaaaagggccaggccatccctctctcgggccacagcctgccatccaggctctgtctcccgggactgcaggccccggttgcatgaaatctaatctctagctggaaatgaaaccaggagctcacagcctcctcccgcatctgtgctcatggtcatttctctaggccagaaagctccgcgccttttctggctctgagagagcttgtgggggacagccttggccctgagaccagtatgggtgcatgtctgggccccacctgggcagccctcactggggacgctgagcatccaggcagctttttccttgagcagtgtgtgtgcaaacaggtgtgcgaccccacacacctggttccaccgtccccctggccaggcccctcatggggcctccgggaggaggtgtcactgtgaccctctcttggcagcgtcaatggagatgtgcgcatctttgatccccggatgcctgagtcggtaaatgtgcttcagatcgtgaaggggctgacggccctggacatccacccccaggcggacctgatcgcatggtaggcgccacccacctccctggcctgcaccgctcacccgcctcgggcctctgtgcaaacgggaggctcttgtgttcctgcccccaggagctgaaggagggcaggggaggatttcactgctgtggggacataaaaacaaaagatgtctgcccaccacatcctcccaggataaactctcagggccctgccaggcccgagtcctcagtgagagtgaccagagggtcacacctgccccgagccagcctgtccccgtggtctagccggcctgtccccgcggtctcggcatctgcgcccatcttccatcctcaaagaagagggcagtgatgccgggaccctttctctccccacagtggctccgtcaatcagttcaccgccatctacaacagcagcggagagctcatcaacaacatcaagtactacgacggcttcatgggccagcgggtcggcgccatcagctgcctggccttccacccgcactgggtcagtgtggcggtgggtgggggtcgggggtcgggggctggggtagagggatgggaggcaaggggacaaggcagcaggggtcctgcctggctaccccacaccacagtggggcccattggctgcctgagggagggacttgcctgggtcccaggatctctagggcccctgccccaccctgcactcgccccggaagcagagccccagtcccgtcactccgggaggaattgacacacagtggctggggcaaagctcctgccctcagaccctgcactaaagccatccctggggacctccaggagagtcgctcggggtgtccatccctgtgcggccctcaccccgtcccctgtgcggccctcaccccgtcccctctgcggccctcaccccgtcccctctgcggccctcaccccgtcccctgtgcggccctcaccccgtcccctgtgcggccctcaccccgtcccctctgcggccctcaccccgtcccctctgcggccctcaccccgtcccctgtgcggccctcaccccgtcccctgtgcggccctcaccccgtcccctctgcggccctcaccccgtcccctctgcgtccctcaccccgtcccctctgcgtccctcaccccgtcccctgtgcggccctcaccccgtcccctgtgcggccctcaccccgtcccctctgcggccctcaccccgtcccctctgcggccctcaccccgtcccctctgcggccctcaccccgtcccctctgcggccctcaccccgtccgctgtgcggccgagtcctcaccctgtcccctgtgcggccgggccccacctgcacggctctctggccttggttgcagcctccccacgtggcttcaggccgttgtttttagattaggattctgcccacctgccgccttgtgttgtgaggctccaggcatgtagctctgctgacacgtgtgacattggatcccagagctgccccgtggggcagtcctgaaaaaaccacgcagggcccggggcagcgccacgcccctcacggagtgcaccatgcatgggccctgcagaggactggtgggaccggcccggcatttccgggcctgaggtgggcgtgggggttcctgagaccccggcaggagctgcctaaggatgcgggttggcctgcgcccccccgccccccgcagtgtctgcccgcacctgaacccctgctcaccccttctctctccttgcagcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaaccccccgacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccacgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagacccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcagactccg

SEQ ID NO: 1559 - DNA, 421549 bp, Homo sapiens; identical to SEQ ID NO: 1558

SEQ ID NO: 1560 - DNA, 10392 bp, Homo sapiens
ttgtgaaacaggtgccctattttactaaaaaccacatatacattacattttacaaaacagcaactatctgatctctcggtcccttccttaaccccataaaaagaaggggatatttggggaccgacgggaacaggttcccctccaaatgctgagggctacccaggcatctccagactcctggtccagtgcagggcagggggcagcggagcccgctcactgctcccatcagcccagggttcctggagcccgtccagagccctcagtgcctaaccagggctggagggaccacctgggtgggcctcagctggactcacagcagctccctgcctgggcggggtccggcctcaggaggaggagtgcgggtatccatagtggttgtggtcagcctcgcccagggtcaacgtcagtgacaggctgggcttccgttccagctcctcctccttcagacagtgctgtgggggtcgggctttgaagaagtctgagatgtagcagacctggtagagcagagggtggtgagaatgggcagggggctgtccaggtaccagggacatgggcatgagcaggagggggaggaacagggtcccaggtgggagcgaggggcctaggtgggaaatgagaggagtagtgcctggggtgggaagagagcgctcttagtggaggaccagtggggagcactgaggagctgacaggccccgggaagaactgcagtagggccaggggtccagagaaggactggggtgcacggaaaggagtcctgtgcactggggtgcaggggaggaatgggggcatggaggggggtccagggaaggactgggattggggggaaggggtcccaggggaggactttgggggtaatgaagagggtccaggtaaggactgggactggggagaaggggtccaggggaggactggggggaaggatggggtaaagggaaggactggggttgggggaaggggtcccagggaggactgacagggaggaggcccaaggaaggactcagtggggcaagggtacccagggcagcactagggttggctggggagtggtctctggacaacacaggggatagagttagggttagaagctcacagtgagggcagccaccagtgccccctgcaggaggccaacaaggacatcgctccagtggtgtttgtaatcagacacgcgggtgtagcccacgtagagggcaaaggccaccaggaagaactggactgtgggtcgcagcagccgtgcccacttccaacagagtcgtgcctgcacatacagctggagtggggagaggacgtgttagcctgtgcacctgccaggcgctccccctccccctgcacagacgtgttagcctgtgcacctgccaggcgctccccctccccctgcacagacgtgttagcctgtgcacctgccaggcgctccccctccccctgcacagacgtgttagccttgcgcctgccaggcgctccccctccccctgcacagacgtgttagcctgtgcacctgccaggcgctccccctccccctgcacagatggcagcactgaggccggaggcaaacactggtcagcccagggcctcccgtttttataaacaaatcagttagcccccctcaccaccactacccacccattttacagctggaaaaactgaggtccagggaagggagtgatttagccatggttcccccgaaaagcaagcccgggagaaacagactcaccgccaagaacaccatgcagtacatcccaaaggaagagtgtcccgagtagaaagacaacctgaggaaggagaaggggcaggtggctcactcagcgccttccaacctcccccttgtccccgccccgcccacagaagggagggctcgacacggaggctgctgctgttagatgcactcaaatcccagtagcagaaactgttccccttttctgttccagtcatctgataatggaataagagtctctgactggggctgtggcatgagatgcctcatccgtgaagactctgaggcctgaacccaaaacccagggcagacaatcatgtctggcaagcaggcaacaccacagtttcattttcaccatgtttcttttcaggattttctcccatctgcggaactgagggaagacttatttttatataaattcaagattcggtgaaggacatcaagaaaatagcagagcaagaaacttcaaaagcaatttttaaaaatggcaaaaaagtcacaatcaacttttttggaactactcaaaagcttgcagccaccagaagacttatcaagataaaccagctgaatctcagaacaaacggccttgtcgcattttaactcatcctggtccctctcccactgcctagactggtggtggcctgaggattccaagaacagactttatttgcaactgtggacgggagtatggctcaagggctggccttgatctcacctgactggacattctcccagtgctgaggtgctacctgggggatatttgtaggaaacattcacaacaaatttattattctctgctgcctggggccacagacagcagatgaggcaaacaacagactaaccaaacaggccagggaataaaatgctctgggcgatgggggcctggaacgcagacagagctgtgcaggagctcaggagaggcctgcgagggccgaagctaagctctcacgtctggccgccttcaggctccgcacacacaggaagcaaaagctaaggcagagttgaaaatgtgtttaaccgcggaagggctgaccccacatgcacacagacccttctacaaactctgggagggttttatgggtttttttgattccagatgtttaaggaaatctctgtcctatcactgaccactgggctaaaagaataggaagaaacggccatacgtgacaaaaaatacagactttacaaccagaaaagtcattaaacaaataactactgcaacaaacagcaagaacaaacccgggagagggcgtaggatcatatttccagagttgctacattataatattctaaacacccagtttaaaacaaagcaaaacaggccgggggtgcggtggctcactcctgtaatcccaggactttgggaggccgaggcaggcggatcacgaggtcaagagaccgagaccatcctggcccacacggtgaaacgccgtctgtaccaaaaatacaaaaattagctgggtgtggtagcacatgcctgtagtcccagctacttgggaggctgaggcaggagatttgcttgaacttgggaggtggaggttgcagtgagccgagatcgccactgcactccaacctggcaatagggtgagactctgtctcaaaaaaaaaaaaaaaattacaaggcatgtagaaaaacacaggtgtggccaatacacagggaaaaaaatgtaataatagaaattgtccctcaggacacccagatgttggacttactagacactttctaagagagggcctgacttgaacttctgggctccagcgatcctcctgcctcaccctcccaaatagctgtgacaacagttgtgtgccaccaagcctgggttctagacaaacacttttagttagccatttaaaatatgttcaaagaaaaaagtaaaaataaataaatactatgttcaaagagccaaaggaatatgagaacaatgtctcaccaaacagagaatatcaataaagagaaagaagttataaaaaggaaccaaataaagatttggttatctgaaatgaaaaatcacttgagggaggctcaatagcaggtctgaggaagcagaagaaaaaagacaatgaacttgaaaataggtcaattggccgggcacagcggctcacacctgtcatcccagcactttgggaggcagagacgggcagatcacaaaggtcgggagttcgagaccagcctggccaacatggcgaaaccccgtctctactaaaaatacaaaaattagctgggcgcagaggcacacgcctgtaatcccagctactcgtgaggctgaggcaggagaatcgcttgaacccaggaggcagaggttgcagtgagctgagattatgccactgcactccagcctgggagacagagcaagactccaactcaaaaaaacaaagaaaataggtcaattaagattatttggcctggcacggtggctcagcctgtaatcccagcactttgggaggccgaggcgggtggatcacctgaggtcaggagttcgagaccagcctagccaacatggtgaaaccccgtctctacttaatacaaaaaattagctgggcatagtggtacacacttgtaatcccagttactcggcaggctgaggcagagaatctcttgaacccgggaggcagaggttacagtgagccgagatcgtgccactgctctccagcctgggggacaagagagagacttcgtttcaaagaaaaaaaaaaagattattcggctggggccaggtgtggtggctcacgcctgctactcaggaggctgaggcaggagaattgcttaaaccgaggaggcagaggctgtagtgagacaagatcacgtcaccgcactccagcctgggcgacacagtgagactctttctcaaaaaaaaaaaaaagaaaaggagaaaaaaaacattattcagcctggccgaaaaaaagaaaaaaaaaaaagattattcagcctggccaggcatggtggctcacgcctgtaatcccagcactttgggaggccagggtgggtggatcacctgagatcaggagttcgagaccagcctggccaacatgatgaaaccccatctctactaaaaatacaaaaagttagtcgggcgtggtggtgcacgcctgtagtcctagctactcaggaatctgaggtaggagaatcgcttgaacccaggaggcagaggttgcagtgagccaagatcacaccactgcacactgcactccagcctgggtgacagaacaacattctgtctcaaaaaataaaattaataaaagtaaatgaaaatacaaaaattagccgggcgtggtggcgcacacctgtaatcccagctactggggaggctgaggcaggagaagcacttgaacccaggagatggaggttgcagtgagccaagattgcaccaccgcactccagcctgggcccagactctgtctcaaaaaaaaaaaagaaaaaaaaaaaagattatttaccctgaacgggctcagtggctcacacctctaatcccagcactttgggaggctgaggcgagaggattgcttgagcccaggcattcgagaccagcctgggcaacatggtgagaccctatttctacaaaaaaatttaaaaaccagctggatttggtggtgtatgcccgtagtaccagctacttggaaggcagaggtgggaggatggtttgagcccaggagttcaagtcctgggcaagatagcaagacccccatctctaaaagaaaaaaaaaattaaaagcaaaacaaacaaacaaaaaaagacagtaatgaggaattgaaaaaagaagatataacctaagcaaacctcaacgaaatgacagaggtccttccttatcagtaattacattgaatataaataaacactccaattaaaagtcaaagtttcattaaatgccttaattcaataaaaagattaatatataatttaaaaaacattaaaaaaaaagtcagagatctggctggatgtggtggcatacacctgtaatcccagcactttaggaggccaaagtgggcggatcgcttgagctcaggagttcaagaccagcctgggcaatatggcaaaaccccgtttctaccaaaaaaaaaataaacagtagctggatgtggtggcacgttcctgtagtcctagctactcgggaggctcaggtgggaagatggcttgagcctgggagtccgaggctgcagtgagctcagatcattgcactccagcctgggtgacagagtgagcctctgtctcaaaaaaaatcagagattggacaatacattaagaaacatggcccaatttcatgctaggtataagacacttactttacagtcagagacataaacaggttgaaagtccaagaatggaaaaaaaaaatattccatgcaaacaataacaaaaagagaaccagaatagctatgttaatatcagacaaaacagacatcaagacaaaaattgttgagacaaaactcatatatctcattctatgatgatgaaatggtcaatctttcaaaaatatataacaattacaaaggtaaatgtactaaacaacagaaccccaaaatacttaaagcaaaaactgacagaatgttacaacatggatgaacttcaaaaacatacaagaatgcactaacttatacaaaaattagccgggcgtggtggcgcacgcctgtagtctcagctgcctgctggctcttcatgatttggctccagggccttcttcagctcccattccccacaagagtgaaggctgctggtccacacccacctggcctcggtgacatcagcagggtttcccctgcacaccttctccagctgcacatagaccgagcagttgacccggctccagtcggggtcgcagacggctaggaagttgggcctcagacgcccaatcatgtacttggccaggtctgtcagagactggctcacggcagccccaaacaggaaggtccccagcaccttgtatacagcagccacgtagttgttgaagtccgagcgagaatagagccggtctgtgtacaccaggtaggcttccccggccgagacctgcaagagcagccgcaggaaccagtgggggtctcggtcggcccaggggccctcactcctccgcacgggcctccccaaggctgctggagagctggggactctgaagggggccctattacccacaggtaccactcagggcaaggctgtgtcccccggccccacacagacctccagggcagggctgtgccacccccccatcaggcccccagggtaaagctggccccaccccatccccctacccagtccctctgagcccctcctgccttacaaggatgacggtggccgtgatggtgaccccagccatgagcccgtgggtgatggtatctggacggtaggggtaccggatggagtcatccccgcagtaaaatcctcgcttgtacggggcgttcaccagcgtcaggatagcgaagggcagggaggctggtggggaagaaaagcctgggagctgtgaggttctctcaccagctgggccttggggccccacacacctgccttggcctggaggcctcccacctctactctcaccagacagcaaggaagagcttttttcacagcccaaataacactccctttcgcatcccctcagacaaacacaaactcctcaggcgctctgcccctcacatcctggcagcctcctttctgctccttgaactaactcagcaaacacccacctttgcacagccacttctctctgcccaaaatatcttttttttttaaatttttaaaagtagagacaggggtctcatgttgaccaggctggtcacaaactcctgggctggagcgatcctccagcatcagcctcccaaagtgctgagattacaggtgtgagccaacgtgccaggccccaaagtatctctaatttatgtgcggggccccaaagtagctctgagtaacctccactctcatctcccctgctgactgtccatgccagcatccctctcacagaaggaaaggtctgctctttttccctcttccttatgcaaacctcatgtggaatttggcagtcacgtgtgggacactggaattgatttccccccatccacccaccggcaccaggaggggcctaccgtattcagggcagagtccctggagcctgctcagggcctggccagggcagatgtttaataaacatcggttaaaataaggcaggacttcttttaacctaagagcaggccagagaagtcaggaagaagccaaggaagggcacagctgagacaccttcgctcacgcacttgccccttcatcgaccagccacgtggtgaccaggacagacccagccctggcctcagggatcaaagacacattcaggagccacttatggaaggtgctgccatggcactggggctcctggggccctgctgagctgagggtggccagggaagcaggagtcatctacggagaacggggcagagggcaggcgcacaacaaaagcccgggtcggctagcccagagacaaaccaaggcagggcatcctttggcccagcagggcaagtacaaaagggtgtggcttttctaagttctgaatgtcagcggaggggcagggagccccacactcctcccgacatgctaactccaagggccctaggacaccgtacaccttccatgctggctaagtctggggaaataatctggtgaagaaaacagaggcctgcctcaccgagcaagaaaggtgagggaatgcagaacagaatgggcaggcccggcgtggtggctcagcactttgggaggccgaggcgggcagatcacgaggtcaggagatcgagaccatcctggctaacacggtgaaaccccaactctactaaaaatacaaaaattatctgggtgtggcggtgtcccagctcctcgggaggctgaggcaggagaatcgtttgaactcaggaggcagaggttgcagtgagccgagattgcaccactgcacaccagcctggcgacagggcgagactctgtctcaagaaagaaaaaaaaagggcagcgccagggcctggaggcagggcaggacggcggagagggcgggatgtaagaacctgccttctgctcccacacaggaggggctggagctgctgtgaagggagaggccttggaggaggctcctgcagttgccggccgggtggaaagtcagggttacgagatgcccagaagggagtgcagcccgaccacagctcttatcgggcggaggctcacacaggttagcctccgtttccgacctccctgccccagcaactccaactagagacgcaggcacccccataacgacaggcgccgggcttccctcggcctggaaagctctccctggggtccccaaaacagacaccttctcttcatttagcccccgggagccctcccgccctcacactgccctcatgccagcatctggaacctcagtgttgactgaactgtggtgtgctcaagcttccagcatagaggtgcactcggcctggccaccacccctggcacacagcagcaacagccaaccccatctcggctgtacctcccgctgctgtgtgacctccggcaggtgactcagcacctccctcacaggctgttgtaagggaaatgtttgttatttgcatgttgcttagttcctggcatacagaaagtgccacctaaatgtttacataaataacaccataggtgctcaggaaatggtaccacgggctggcagacacccacagggacttcttgctgtcacctggcccaccctaaaaaagggtctccttccggaggtaagaggacttggcctctgctgtgagatggcagagaagcaggaaacacgttggggaggagggcaccccccagagatagaattccagggccattgtctgtgcagccacagagcaaacactcggcctttgttcccgggaccctgcgggaggggggcctcgggatgcccattccgccagtgtggcccgcaaacccgccggacaggtttggttctcctggcctcccggccccccgccaccccgttcacccgaagcctgggacccagccttcatccccagtgtctcccccgcccgagccagcagggcggctgggcctccccgcacgtgcacgggttcgaatcccgccgacgcaccgggtgccaggaccgagggtcagccctctccgcgcgcagcgggagcgcccaccccaggggcggaggcgcggacgtcctgccggggtaacccgcggccgcccccacctcccgggcccgcgtgactcacctcccaggccaggcggggcgggatggaggcgcgcgcgcggcccctccgcacagacttcctgctgccggggcgggggatgctggccccggctccccgggcctctcgcgacccccatccccctgggcctgggacgcggggacccccgagcctgggagggcgcgcgcagtgcggggcgcggagggaggtctggtcctcacgcgaggtccccgcctccagggtcctcggagggacgagggcgcgcagcctccgcgttcccctgcaaacttgcgcgcagccgggggcgtgtccgtcccgggagggtccccccaacacccgggtccccaaggctcttaccgaccagtaagcacagcacgtcgagcagcacgaagacccacctccgctgcatggtccccgcgacccccgacgccggtcccagcgcgtcccgtcgcgtcccggcccggccgcggagtcacgtggcgcggagcccgccccgcgcggagaggag

SEQ ID NO: 1561 - DNA, 10392 bp, Homo sapiens; identical to SEQ ID NO: 1560

SEQ ID NO: 1562 - DNA, 10126 bp, Homo sapiens
ttgtgaaacaggtgccctattttactaaaaaccacatatacattacattttacaaaacagcaactatctgatctctcggtcccttccttaaccccataaaaagaaggggatatttggggaccgacgggaacaggttcccctccaaatgctgagggctacccaggcatctccagactcctggtccagtgcagggcagggggcagcggagcccgctcactgctcccatcagcccagggttcctggagcccgtccagagccctcagtgcctaaccagggctggagggaccacctgggtgggcctcagctggactcacagcagctccctgcctgggcggggtccggcctcaggaggaggagtgcgggtatccatagtggttgtggtcagcctcgcccagggtcaacgtcagtgacaggctgggcttccgttccagctcctcctccttcagacagtgctgtgggggtcgggctttgaagaagtctgagatgtagcagacctggtagagcagagggtggtgagaatgggcagggggctgtccaggtaccagggacatgggcatgagcaggagggggaggaacagggtcccaggtgggagcgaggggcctaggtgggaaatgagaggagtagtgcctggggtgggaagagagcgctcttagtggaggaccagtggggagcactgaggagctgacaggccccgggaagaactgcagtagggccaggggtccagagaaggactggggtgcacggaaaggagtcctgtgcactggggtgcaggggaggaatgggggcatggaggggggtccagggaaggactgggattggggggaaggggtcccaggggaggactttgggggtaatgaagagggtccaggtaaggactgggactggggagaaggggtccaggggaggactggggggaaggatggggtaaagggaaggactggggttgggggaaggggtcccagggaggactgacagggaggaggcccaaggaaggactcagtggggcaagggtacccagggcagcactagggttggctggggagtggtctctggacaacacaggggatagagttagggttagaagctcacagtgagggcagccaccagtgccccctgcaggaggccaacaaggacatcgctccagtggtgtttgtaatcagacacgcgggtgtagcccacgtagagggcaaaggccaccaggaagaactggactgtgggtcgcagcagccgtgcccacttccaacagagtcgtgcctgcacatacagctggagtggggagaggacgtgttagcctgtgcacctgccaggcgctccccctccccctgcacagacgtgttagcctgtgcacctgccaggcgctccccctccccctgcacagacgtgttagcctgtgcacctgccaggcgctccccctccccctgcacagacgtgttagccttgcgcctgccaggcgctccccctccccctgcacagacgtgttagcctgtgcacctgccaggcgctccccctccccctgcacagatggcagcactgaggccggaggcaaacactggtcagcccagggcctcccgtttttataaacaaatcagttagcccccctcaccaccactacccacccattttacagctggaaaaactgaggtccagggaagggagtgatttagccatggttcccccgaaaagcaagcccgggagaaacagactcaccgccaagaacaccatgcagtacatcccaaaggaagagtgtcccgagtagaaagacaacctgaggaaggagaaggggcaggtggctcactcagcgccttccaacctcccccttgtccccgccccgcccacagaagggagggctcgacacggaggctgctgctgttagatgcactcaaatcccagtagcagaaactgttccccttttctgttccagtcatctgataatggaataagagtctctgactggggctgtggcatgagatgcctcatccgtgaagactctgaggcctgaacccaaaacccagggcagacaatcatgtctggcaagcaggcaacaccacagtttcattttcaccatgtttcttttcaggattttctcccatctgcggaactgagggaagacttatttttatataaattcaagattcggtgaaggacatcaagaaaatagcagagcaagaaacttcaaaagcaatttttaaaaatggcaaaaaagtcacaatcaacttttttggaactactcaaaagcttgcagccaccagaagacttatcaagataaaccagctgaatctcagaacaaacggccttgtcgcattttaactcatcctggtccctctcccactgcctagactggtggtggcctgaggattccaagaacagactttatttgcaactgtggacgggagtatggctcaagggctggccttgatctcacctgactggacattctcccagtgctgaggtgctacctgggggatatttgtaggaaacattcacaacaaatttattattctctgctgcctggggccacagacagcagatgaggcaaacaacagactaaccaaacaggccagggaataaaatgctctgggcgatgggggcctggaacgcagacagagctgtgcaggagctcaggagaggcctgcgagggccgaagctaagctctcacgtctggccgccttcaggctccgcacacacaggaagcaaaagctaaggcagagttgaaaatgtgtttaaccgcggaagggctgaccccacatgcacacagacccttctacaaactctgggagggttttatgggtttttttgattccagatgtttaaggaaatctctgtcctatcactgaccactgggctaaaagaataggaagaaacggccatacgtgacaaaaaatacagactttacaaccagaaaagtcattaaacaaataactactgcaacaaacagcaagaacaaacccgggagagggcgtaggatcatatttccagagttgctacattataatattctaaacacccagtttaaaacaaagcaaaacaggccgggggtgcggtggctcactcctgtaatcccaggactttgggaggccgaggcaggcggatcacgaggtcaagagaccgagaccatcctggcccacacggtgaaacgccgtctgtaccaaaaatacaaaaattagctgggtgtggtagcacatgcctgtagtcccagctacttgggaggctgaggcaggagatttgcttgaacttgggaggtggaggttgcagtgagccgagatcgccactgcactccaacctggcaatagggtgagactctgtctcaaaaaaaaaaaaaaaattacaaggcatgtagaaaaacacaggtgtggccaatacacagggaaaaaaatgtaataatagaaattgtccctcaggacacccagatgttggacttactagacactttctaagagagggcctgacttgaacttctgggctccagcgatcctcctgcctcaccctcccaaatagctgtgacaacagttgtgtgccaccaagcctgggttctagacaaacacttttagttagccatttaaaatatgttcaaagaaaaaagtaaaaataaataaatactatgttcaaagagccaaaggaatatgagaacaatgtctcaccaaacagagaatatcaataaagagaaagaagttataaaaaggaaccaaataaagatttggttatctgaaatgaaaaatcacttgagggaggctcaatagcaggtctgaggaagcagaagaaaaaagacaatgaacttgaaaataggtcaattggccgggcacagcggctcacacctgtcatcccagcactttgggaggcagagacgggcagatcacaaaggtcgggagttcgagaccagcctggccaacatggcgaaaccccgtctctactaaaaatacaaaaattagctgggcgcagaggcacacgcctgtaatcccagctactcgtgaggctgaggcaggagaatcgcttgaacccaggaggcagaggttgcagtgagctgagattatgccactgcactccagcctgggagacagagcaagactccaactcaaaaaaacaaagaaaataggtcaattaagattatttggcctggcacggtggctcagcctgtaatcccagcactttgggaggccgaggcgggtggatcacctgaggtcaggagttcgagaccagcctagccaacatggtgaaaccccgtctctacttaatacaaaaaattagctgggcatagtggtacacacttgtaatcccagttactcggcaggctgaggcagagaatctcttgaacccgggaggcagaggttacagtgagccgagatcgtgccactgctctccagcctgggggacaagagagagacttcgtttcaaagaaaaaaaaaaagattattcggctggggccaggtgtggtggctcacgcctgctactcaggaggctgaggcaggagaattgcttaaaccgaggaggcagaggctgtagtgagacaagatcacgtcaccgcactccagcctgggcgacacagtgagactctttctcaaaaaaaaaaaaaagaaaaggagaaaaaaaacattattcagcctggccgaaaaaaagaaaaaaaaaaaagattattcagcctggccaggcatggtggctcacgcctgtaatcccagcactttgggaggccagggtgggtggatcacctgagatcaggagttcgagaccagcctggccaacatgatgaaaccccatctctactaaaaatacaaaaagttagtcgggcgtggtggtgcacgcctgtagtcctagctactcaggaatctgaggtaggagaatcgcttgaacccaggaggcagaggttgcagtgagccaagatcacaccactgcacactgcactccagcctgggtgacagaacaacattctgtctcaaaaaataaaattaataaaagtaaatgaaaatacaaaaattagccgggcgtggtggcgcacacctgtaatcccagctactggggaggctgaggcaggagaagcacttgaacccaggagatggaggttgcagtgagccaagattgcaccaccgcactccagcctgggcccagactctgtctcaaaaaaaaaaaagaaaaaaaaaaaagattatttaccctgaacgggctcagtggctcacacctctaatcccagcactttgggaggctgaggcgagaggattgcttgagcccaggcattcgagaccagcctgggcaacatggtgagaccctatttctacaaaaaaatttaaaaaccagctggatttggtggtgtatgcccgtagtaccagctacttggaaggcagaggtgggaggatggtttgagcccaggagttcaagtcctgggcaagatagcaagacccccatctctaaaagaaaaaaaaaattaaaagcaaaacaaacaaacaaaaaaagacagtaatgaggaattgaaaaaagaagatataacctaagcaaacctcaacgaaatgacagaggtccttccttatcagtaattacattgaatataaataaacactccaattaaaagtcaaagtttcattaaatgccttaattcaataaaaagattaatatataatttaaaaaacattaaaaaaaaagtcagagatctggctggatgtggtggcatacacctgtaatcccagcactttaggaggccaaagtgggcggatcgcttgagctcaggagttcaagaccagcctgggcaatatggcaaaaccccgtttctaccaaaaaaaaaataaacagtagctggatgtggtggcacgttcctgtagtcctagctactcgggaggctcaggtgggaagatggcttgagcctgggagtccgaggctgcagtgagctcagatcattgcactccagcctgggtgacagagtgagcctctgtctcaaaaaaaatcagagattggacaatacattaagaaacatggcccaatttcatgctaggtataagacacttactttacagtcagagacataaacaggttgaaagtccaagaatggaaaaaaaaaatattccatgcaaacaataacaaaaagagaaccagaatagctatgttaatatcagacaaaacagacatcaagacaaaaattgttgagacaaaactcatatatctcattctatgatgatgaaatggtcaatctttcaaaaatatataacaattacaaaggtaaatgtactaaacaacagaaccccaaaatacttaaagcaaaaactgacagaatgttacaacatggatgaacttcaaaaacatacaagaatgcactaacttatacaaaaattagccgggcgtggtggcgcacgcctgtagtctcagctgcctgctggctcttcatgatttggctccagggccttcttcagctcccattccccacaagagtgaaggctgctggtccacacccacctggcctcggtgacatcagcagggtttcccctgcacaccttctccagctgcacatagaccgagcagttgacccggctccagtcggggtcgcagacggctaggaagttgggcctcagacgcccaatcatgtacttggccaggtctgtcagagactggctcacggcagccccaaacaggaaggtccccagcaccttgtatacagcagccacgtagttgttgaagtccgagcgagaatagagccggtctgtgtacaccaggtaggcttccccggccgagacctgcaagagcagccgcaggaaccagtgggggtctcggtcggcccaggggccctcactcctccgcacgggcctccccaaggctgctggagagctggggactctgaagggggccctattacccacaggtaccactcagggcaaggctgtgtcccccggccccacacagacctccagggcagggctgtgccacccccccatcaggcccccagggtaaagctggccccaccccatccccctacccagtccctctgagcccctcctgccttacaaggatgacggtggccgtgatggtgaccccagccatgagcccgtgggtgatggtatctggacggtaggggtaccggatggagtcatccccgcagtaaaatcctcgcttgtacggggcgttcaccagcgtcaggatagcgaagggcagggaggctggtggggaagaaaagcctgggagctgtgaggttctctcaccagctgggccttggggccccacacacctgccttggcctggaggcctcccacctctactctcaccagacagcaaggaagagcttttttcacagcccaaataacactccctttcgcatcccctcagacaaacacaaactcctcaggcgctctgcccctcacatcctggcagcctcctttctgctccttgaactaactcagcaaacacccacctttgcacagccacttctctctgcccaaaatatcttttttttttaaatttttaaaagtagagacaggggtctcatgttgaccaggctggtcacaaactcctgggctggagcgatcctccagcatcagcctcccaaagtgctgagattacaggtgtgagccaacgtgccaggccccaaagtatctctaatttatgtgcggggccccaaagtagctctgagtaacctccactctcatctcccctgctgactgtccatgccagcatccctctcacagaaggaaaggtctgctctttttccctcttccttatgcaaacctcatgtggaatttggcagtcacgtgtgggacactggaattgatttccccccatccacccaccggcaccaggaggggcctaccgtattcagggcagagtccctggagcctgctcagggcctggccagggcagatgtttaataaacatcggttaaaataaggcaggacttcttttaacctaagagcaggccagagaagtcaggaagaagccaaggaagggcacagctgagacaccttcgctcacgcacttgccccttcatcgaccagccacgtggtgaccaggacagacccagccctggcctcagggatcaaagacacattcaggagccacttatggaaggtgctgccatggcactggggctcctggggccctgctgagctgagggtggccagggaagcaggagtcatctacggagaacggggcagagggcaggcgcacaacaaaagcccgggtcggctagcccagagacaaaccaaggcagggcatcctttggcccagcagggcaagtacaaaagggtgtggcttttctaagttctgaatgtcagcggaggggcagggagccccacactcctcccgacatgctaactccaagggccctaggacaccgtacaccttccatgctggctaagtctggggaaataatctggtgaagaaaacagaggcctgcctcaccgagcaagaaaggtgagggaatgcagaacagaatgggcaggcccggcgtggtggctcagcactttgggaggccgaggcgggcagatcacgaggtcaggagatcgagaccatcctggctaacacggtgaaaccccaactctactaaaaatacaaaaattatctgggtgtggcggtgtcccagctcctcgggaggctgaggcaggagaatcgtttgaactcaggaggcagaggttgcagtgagccgagattgcaccactgcacaccagcctggcgacagggcgagactctgtctcaagaaagaaaaaaaaagggcagcgccagggcctggaggcagggcaggacggcggagagggcgggatgtaagaacctgccttctgctcccacacaggaggggctggagctgctgtgaagggagaggccttggaggaggctcctgcagttgccggccgggtggaaagtcagggttacgagatgcccagaagggagtgcagcccgaccacagctcttatcgggcggaggctcacacaggttagcctccgtttccgacctccctgccccagcaactccaactagagacgcaggcacccccataacgacaggcgccgggcttccctcggcctggaaagctctccctggggtccccaaaacagacaccttctcttcatttagcccccgggagccctcccgccctcacactgccctcatgccagcatctggaacctcagtgttgactgaactgtggtgtgctcaagcttccagcatagaggtgcactcggcctggccaccacccctggcacacagcagcaacagccaaccccatctcggctgtacctcccgctgctgtgtgacctccggcaggtgactcagcacctccctcacaggctgttgtaagggaaatgtttgttatttgcatgttgcttagttcctggcatacagaaagtgccacctaaatgtttacataaataacaccataggtgctcaggaaatggtaccacgggctggcagacacccacagggacttcttgctgtcacctggcccaccctaaaaaagggtctccttccggaggtaagaggacttggcctctgctgtgagatggcagagaagcaggaaacacgttggggaggagggcaccccccagagatagaattccagggccattgtctgtgcagccacagagcaaacactcggcctttgttcccgggaccctgcgggaggggggcctcgggatgcccattccgccagtgtggcccgcaaacccgccggacaggtttggttctcctggcctcccggccccccgccaccccgttcacccgaagcctgggacccagccttcatccccagtgtctcccccgcccgagccagcagggcggctgggcctccccgcacgtgcacgggttcgaatcccgccgacgcaccgggtgccaggaccgagggtcagccctctccgcgcgcagcgggagcgcccaccccaggggcggaggcgcggacgtcctgccggggtaacccgcggccgcccccacctcccgggcccgcgtgactcacctcccaggccaggcggggcgggatggaggcgcgcgcgcggcccctccgcacagacttcctgctgccggggcgggggatgctggccccggctccccgggcctctcgcgacccccatccccctgggcctgggacgcggggacccccgagcctgggagggcgcgcgcagtgcggggcgcggagggaggtctggtcctcacgcgaggtccccgcctccaggg

SEQ ID NO: 1563 - DNA, 85 bp, Homo sapiens
tctcatgatgtgaccatctggaggtaagaagcactttgtgttttgtgaaagaaagtgcttcctttcagagggttactctttgaga

SEQ ID NO: 1564 - DNA, 65 bp, Homo sapiens
gtgaccctctagagggaagcactttctgttgaaagaaaagaacatgcatcctttcagagggttac

SEQ ID NO: 1565 - DNA, 85 bp, Homo sapiens
tctcaagctgtgactgcaaagggaagccctttctgttgtctgaaagaagagaaagcgcttccctttgctggattacggtttgaga

SEQ ID NO: 1566 - DNA, 88 bp, Homo sapiens
tctcaggctgtgaccctctagagggaagcgctttctgttggctaaaagaaaagaaagcgcttcccttcagagtgttaacgctttgaga

SEQ ID NO: 1567 - DNA, 402537 bp, Homo sapiens
  misc_feature (76200)..(136199): n is a, c, g, or t
gtcaggcttgtcctgggccaggaggagctgaggctgcagaccccagcagaaattctactgagtggctccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgatgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcaccttccagctccttggcaccccctctggcctccccgtggagcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccgtgtcaccggaggcctgccgttcagggagctgcagaagcagggggctggtggggtggaggatgctgagtggtgggtcacacaggcgttccaccagcaggatgtggagcagggccacgtgaggtacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacatgcctcagtggcagtggaggacaccttctgtttccatgtcacagctccaccatatttctccccactctgtaccttctccatccatattggcggtgacccagacatgcctgtcctcgtggtgcccgagggtggtgggtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccatcaggaccagagcagtggtgacgtggcctgggaggaggtatggggtgtcttctgagtggccatccagcctgtgaatgaccacgcccctatgcagaccatcagctgcgtcttccacgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgtgtgtgtgcacgtgcctcagatgtgctcccatatatgttgtgttcccaagagtttctggggagcttgctgtacacccatcctcctgggagtggtgtgtgcctctagagctggtgtccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtaccccgctctcttctcagagcccagaccaggaccaggagggtctgtcaagggcttctgctcacccaggaaccccacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccacgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcgtcagcatctgatgaactcatatgtctgtgtcactgagtctggggacatgtgattatgcacctccctgagggagtgcatctcaagctgttgaccgacaccccgtaaccatgtgtggggtgggtattaacatgtgaccagctggggcaacccagtgaaaccccatctctacacaaaacatttaaaaattagccaggcatggtggcacatgactgtggtccccagctacttgggaggctgagcccttgagcctaggacgttgaggctgcagggagctgtgatcacaccacagcactccagcctgggtgacagagtgagaccctgtctcaaaaaaacaaaaaatgtgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctgcttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtactgctggggcctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccaccccccatgtctgctttgagaaagaggccaatgtcccctacttcccggcacagatctcccccactctgagcctcagtttcctcctctgcaaaatgaggacactactgtgtgcctcacgcagttgttggaaggagagatgtgagattgtgctgaaatagaacacaggtgggaggttttgttattggacatttgcaagtacggtaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtggaggcctcagcttggcttcccaaactcctgccccttgtccacagcagagcagggcccccatttggcaaaggtggaagttgaggcccagagatgggatggaacttctccatgattgcaaaagtagttctggtggaacagaaagggcatggctttactaagcccacgtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggacgccacagaagagtgggacacagcaccctggaaccacaggctgggatggctgtgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagagtggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagctagattaaggagcactgttggtcagcgctgggggtttctgggggtgagaacttggtgacggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgggtagtgcagtgggcggtgccgggcactgaggtgcgcagcttcaagcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacggaggcatccactttggcctctctgacggtgaacatacttcctccagacacttagcttctgagtgacggcccagaagcaagtgcttcactcgctggagggcagccggacactgactgcccaggtgggtgtgctgattgtgggcgttcctgggtgcggggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggagtcatcaggctggcagggcaagttcatgttcccagaaggagggagaagaatgcaggaagtcggggatacagggccccagagcagggctggggtcttggggtgtggcttcccgaaggaagctagagctggacccaagggtctggagagggagaaccatgtaggggcactagtggcaccccagcagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaactgtgccacgggggccagcccactcatggtttaaatgaacacctctccccaaaggcagaatgggagttgttccatagcagggcagggcagggcagggcagactcttgtgggccgccctgggcaggcagcacacctgatgctcccatcaggaggctgcgtgagcatctggacccagcacatgatcacagtgagttctcggcagggagcggtcttgtggggcgcagagctgactctgtcactcaggagccacggcacacagcactgccccaagtacctccagaggggatccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggctggtgtctacagctgctgcgtaccctcagttgctgggagcctttgtcaagaatgcccaggaatgaggagggcacaggacccagaccatcagcaaccctcttgcactctatagtcccatgttactcagagcttccccatgctccagcaagatgaaggactagattgaatgggcaccaggctggcagtgccacccaggaaagctgggaagaggctacatgggctacctggcccactcagggaggagggcaggactgggtattgtcttgacagcaaccctgtcccacaacactgaactgggcagggaaggggtcaggtgtcctcatttttcagataagaaaactgaagctcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataagtcttaagtcccctcccagatctgtgacatttgacaggtgtcttttcctctggacctcggtgtccccatctgagtgagaaaaggcagtggggaggtggatcttccagtcgaagcggtatagaagcccgtgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcatgacgagatgctgcacatgcaccacgcgctgaaggaggcgctcagcatcatcggtgacatcaacaggaccactgtcaccatgcccatgcccccgcccgtggacgacacctggttgtcagagcatccctgacgaacacaggtaccaaagactgccccccacggccccaaaatcccccacccgggatgcccagaggagtgccctgggggcaagtggcacaccccctcaccggggtggctcccacctggagtgacggggggagcttgacaaggagcactggctgccggggggggggggggggggtgtggagctgggatgttctcgctgctgggggcggggcttaagctctggcaaccgccttggggtgtggccggcactgcgctggggcggggtcgcccatctctcccctccctgtgcctcccaggtcgcccaagtccagcgtcaggatgcccaggccctgccatgtccctagcccggcctgggtggcagggcccagctcctgggcggcaggacccagctcctgggcttcctcctgccgggtccgcccttggggaagcgtgccccataccctccaggccagaggcttcccctgatccctttgggccctacccccctggtgctctcgtgccccagccggggtccccaggtaagtaggggctgaatgcggctgaagaggccgctggacaggcgtggccaggaaggaaatgggactggattccagagcaccacatctggccgccagaactggccgtctccatccaaggcactgggaccatgggtgccggagccacgtgtggccgagggctggcagagcctgccccccagggatcactgagtcctggaggtggtcgtttttgaggagggggctgtggggctcgtcccacctgccgccttctgtccagcacttgcatgacacttccctctattttcactcttggcggctgcccacacgttgcatttctcttcctttcttctcgctgtcctccatcctccattccgtccaactcctagcccagtcccgggggcgcctacttcaggtctgagagtctgaactccgagatgctctgggtgtgtggatttccttcagctaccctgatgtccccacttccaagtcctgactcctttgagccatcccagggggtgtccggccactggaccacaggagcagaggcgagtctgtgactgtgtgaccagcaaggtgtgtgatgtgtgcgtgagcgagcacacgagtgtaaagaatggcacccagacctgagctaggacagagggagcctgggggccacaggcaagctcatttcttctccacacccctccccgcccgaccctgtctaaactaatggggtagtggtagccgcaagggcagggatgggagtggctgaagcctacttcactcccaaagatttctaaggaaaatggttctactgcatcctttggctgggccttgttgacccgtgaccctctttcaagaacattcactctgatttccagtgtgccgtctccactggccacgttctctaaggaagaacaatagcatctgtttttgtttccaaatggctggagagtggggctgtgggaccagcgcccatatataaaaatgaagcagggattggggcttgccctgtgatgtgctgttgaccaagttagaggggtataggcaagcagcaaagtattgggcaagatcactggactgggagtccagagatgctgcttcaccctggggctttaggcaagtccctttccctcccagagcctcagcatcccttttagcaaattatgacattctgcctttctcctaggatggctgtggggatcaagggagacagtggccatagggatgctatgttaaccgcagatgcggctgtaggagcactttgctaactgccaacgtgagttcagactcttcaggctatttggcacccaggtctatggtgaggtgtgacatatgggatgtaaagtttgatgcctgctctgactccagtcttgctaacacacacacgaaacctttggcaaatcatgaccctgccttggggaaaagggcagtctgggagagcttcttcaaggcagcctggcttcaatgcagtccggggcatgactgagataggcatacgttgtgaggaactggagggtaactgggtaaagagctgcagtgtgggcagaggtgtagtgtgggtcacattgaggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctcttaggtggagaaatgacagccggacattagtgagcaagccctgtctccctgagcaggatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgcggcacgtgccggctggtgagggtgttgggcaccgggaggtggcggagagggcgacgtatgcgtgttgtttgtgggcatgtgttagagtgtgcatgcgggccgtggggcctcacagcatgtgtgtgcacaatctggcgtgtgcgtgtgtccgccacccccaggcctgccccacccatgcatgggacctgccatgtgatttgatgctgtctttcagaatcactatcagtggcccctgaggagcatcagccatggtaggtacatgcctcactgcctgctgcatgaatggtctgcccgccccgctgccccagctccacacagggggcatacctggagcctcagagccaggctgcctgcccctcccttctagagctgcagccttgctctttcctctttctgtccttgtgctgctggctgtctcacttccctccctgccagccacaggactcagtgccactgctcaaggtctccatggctgagcctgggggctcttacaacaggctccatgccgaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccgagagccaaatccactgcagattaggggtgatagtcacggtcccacgtcctctatctgtcagcaatccagtggtgatctaggataaaagcctgagagtcctatacacgcggtcatcccacaacacacttcataggccatgcaaggacacacagcccccttccctccctcccaggtaccatcacagctgctagcatgtgactgaaggctgggtccctggccagcactactgaagcactactgccagccagcaggctcacggaccttggcctgttgctcctaggggtcacctgtgctattcagccaaggagaccacagtgcttgctggcccagctgagctccgcctagcgagcccacctgcctttcctgccgcggagtctccctcttctgcttttcccagcaggaagggcccagcctcacctatgcaacctgcagccccccgccaaccagttgaggttcccctcttagacttataagtctatgggcagtggcatctagctacctgccctccctgccttccccagggtcccttcagtggaccctgggctttctgactgcccagagaggggcctctggcgctcactccagccagccatcccttacagcttcaccattttggttcaagcagtgttccttctgtcaggcttggtggctgttgggtggggctccccaagcaagaggtggccctgggccagtgggttggaagatggggtgaccacagaagagggaagccgggggagttgagcattggtctgaactgtgggtggactgcctgggtgccatgagagaggccagtgtgtgtggggtggggaggaccgccacagcccccaggcactacctatgaagctctagcttctccctccatcttcctcccctttcccttccagcccctcttttccaggaaccttgccacgcccacacctacgccttccccttcccggctctcagatgatggtggtgtttatctccctgttcttgggagcccaaaaagaatggcatgcaggggttgctgcccatgcctgggtgctcctggggagtcctgcattacaggaagcagctgctggatctgctgtgcagtggggttgtcgtggggagaaccctccctgtcctctcctggtgcagcctccacgctatcagtgaggctcacctcacaaagatcttcagagagagggagggggggtgggaatctgagcacagtgtgagcctcccctgctcctgcctgcccaccccgcctgagggctctactcaccaccctgctcgtcagcacacccaagctcctgggctattggggctcctagagtgggctcatcagcagggttctgggcaatggtcagaatttgccatgcccctccttgtggtctcccacaagctgcaacacctgccccgcagctcctgcaggttcacctggaggaaggggtgttagctgccatgccggtgccagcacgcacgttcacacccacccccaccctcccccaccgagatgttgcacaccctaccttcatctcctcctggtcctgggccagcctgacgatgtcctcctctcccagtgctgcgtctctgacactgccccctggctgatgtactttcctgcaggaggacatggctcagatgctggggcccctcagacggcctggcagctccccccagcggtgccctagcctctcactccctatggtgtctgtctgtcctgagaggtggatgaattgaagctctagtttctctacccgctccttcaggtccaccttctccttccataaagtcgctgtggagccaaaataatggggtcacatgtcaggagtcacctgccttgtcctgcccccccgccccccttgttggcccatgccaggacctactcacctgcagcttctccatggccccctgcagggcccggtgggtctccccaaacacagactcacccccactctctggggctggggccgctacctctggctttttctgggacgaggccactgggtgagccaggggctggcagcacaccctttgttcctcctgggcattggctccagcggagttgaaaaatgccacctgaagacaagaggtgagtattcttgtaggggtatacacataacaactggggcaggcagatggagcatagccccttcatttcgggcctcacagagtgcacctgttggtcacaggtgaaatggtgtctgaccactggctcccagaagcagagaaagtccacagaagtcagaaggcggggaaaccaagaacataagggggtttcggagggaccacagaggaaggtggcaaagtaggggcagggaaagtcaggctcaccatggcctcccggctctccaggtcccctgggatgttcggcatgggccgaagcgcctcctgctcactgtccagatgtcctcctccatctcctgtggggggtggccagaggggtcctcagacaacccaacaagggaggtacagtgggcccgcctctgcccccacactcactgtgtaaccttgagccagcccctccccagaggggaatgagctgttctttattttgaattttaagaaccaagatcttgctatattgcccaggcacagtcccactaccgattggtgcaggaattctgacctgctccctttctgacctgggccagttctcccatccttaggcaagccgatgacctgttcccaggaggtcaccatactgatactgaacttagtgcggacaccttgtcggcataatgaccgacacaaaatgcttaaaaggtaacctgactctttgttcagggctcagtcctttagatgttaatctgactgggccggtgcacctaaataatatatatcctcctcagtctctctgattcctaaattatgctgctgtacggggagagaggcagcagggtagtggagtcataccaagcaacaagacagggtagtggccaggcatggtggctcacacctgtaatcccagcaatttgggaggccaaggcgggtggatcacctgaggtcaggagttcgagaccagcctggccaacatgatgaaaccccatctctactaaaaacacaaaaattagctgggcatggtggcaggtgcctgtaatcccagctactcaggaggctgaggcaggagaattgcttgaacccaggagatggaagttgcagtaagccaagattgtgccattgcactccagccagggggacaagagggagacttcacctcgaaagacagacagacaggctagtacgttttccacaaatttcaattttactctcttcccccaccacacacacacacacacacaaagcatttgagggatgggaggaagaaactgagatcacagggaaaattgtaagagacattcagaaggacaggtcttagaaatttactagtttgggggggaggtcagaacaggtgtatataaaagaatattaagacagttcccaggtttaggcatatgtgactagatagagtgctaggagatggatacgtgaaaatttaaatatcatcattttgaacacccatgtcactccaagtgagattccctaaatatatgatatacagacagatatatgggtttgaaactctggagatgaatacaaatttaggagtccctggaacacaggtcatgacttaagtaatgggagtcaaagattactcagagaaagcacagaatgagaagagaagaagtaggacaaggaagaagagatcggaggagaccaagaaagggtgataagatcaaaacaggagaaaagaatccgacagaagtctcatttgattatcatgtcccttcccagaggacagggacatgtcttttttgtcttttatacccaattatcacaggtcctggtgcagcagacacacagtttttttttttttaattgtgttgtactactcacagtttcctgtattcaccaggggagaaaaaagtaagtataaagaagcacagacacagatgtttttacactgtgtactaaaggggtcagattatacacaatattttatgccttacttttttacttaatatatcttagaagtttgcacgtgctcttatggaaagactggctgcattttttggtccacaacagaacaacagaatattataaaacggtacactataatttttatttaaccaactctttattggtggacattaagaatggaggaatgtttcaacaaaggaacaacagtatcaaaatactgcagaggggacaatttggggactaagaggggagccactggatttgacaactaggagataaattttagtgcaacgatgaaggcagaatccagagtataatgagctcagtgaaaaaaggtgaagacatgtagcttattctctcaagaaactaggctatgataaactggcagaggctctaagagtgggaggtgagttgttttctccttcatgtaaatatatttaccttttaaacactaggcccaattttatatcctatttcatttaactttatgaacatatttatgtatgtatgcatgtatgtatgtatctcatgtggtgttttagacactgaaaaataactcatttctattataaaactgatatctttagatgttcagaagcaacttcctaaaaggaggtagcagtaatggagctatgtctatcattctttcccatcaacccccttgatggagatgtaaacatgtgtccatcaagcctttaatttttacctcttatcttcatggctctccatataaaacttaactcttttttttttctatttgtatacgtatatttatatgtatatctatatcgagagagagagagagagaaagagtcttgctatgttgcccaggctgatctcaaactcctgggctcaagcaatcctcccaccttggcctcgcaaagtgctgggattacaggcgtgaaccactgtgcccagcctcagccttaactcttaaaatatcttcaaaccaatattcttctgttctaatttttaagaatagatgtgtttaaaccaactaacttattttgacaaaaattggagttaagactcagacttcctcaaatagttctcctaaaaccatttacagaataatctatcttttcagtattaagttaaaataccaccttttccttatactaaattctcgtttgcatgactctggttctaaacttccattgcctttatctgtctggcccagggatagtccacaatattttatttactatctggttgaaagagtctatactttattaatttttattacttattcttctaaacaaattttagagtcgttttgtcaagtgtcaaaaataaatctgccagaatttgtactgaaatttgtgtgtgtgtgtatatatatataatacacacacactatatataaaatataaaatgtatatatacaatttatatatataaatatttataaaatatgaaatatatatatatacacacacacttttctagtttttttttttttttttttttttgagacagggtctcactctgtcacctaggctggagttcagaggcatgatctcggctcactgcaacctctgcctcccaggctcaagtgctcctcccacctcagcctcagaagtagttggaaatacaagtgtgtgccacagacacccagctaattgtcatctacccgcctcagcttcccaaactgtttggattacaggtatgagccactgtgcccagcagaaattacatttacaaattaatatgaagacatggtgataactaacatatttataacatgaaatctgctcatccaggaacatagaatgcaaatctttcattccactcagcaaaattttgtcctgtccttgataaaagtcctgcacatctaagtttattcctaggcatttaatttttgctgaaatacctgaaaaaatacttcatcactatatcttctatgtgattatagctaacattggggaaggctattgatttttatataaaagaacttttaaccagtaatcttaaaaattgttttttctcagttggttcctttggatatttttaggtaaacaatcatgtcaactgaaaataatgattatttttctataaagactatgacatcacaggaaaatacagtaaatactttttaaaagaatataaaagggccaggcacagtggctcacgcctgtaatcccagcactttgggaggccaaggtgggcagaccatgaggtcaggagatcgagaccatcctggctaacacggtggaaccccatctctactaaaaaatacaaaaaattagccgggaatggtggcgggcgcctgtagtcccagctactggggaggctgaggcaggagaatggtgggaacccaggaggtggagcttgcagtgagccgagaccacggcactgcactccagcctgggtgacagagcaagactctgtctcaaaaaaaaaaaaaaaaaaaaaaaaaatatatatatatatatatatatataaaactatagagaatatgacctcaactattaagcatatgtgtaagggttatgtattttaatagcaaagaaaaaatatatactggtagaaaatgaccatcatgtcaacagtcaatagtggttatattagatagagaaattatgggagactttaatttttttcttttatcttttctgtactttaccaattttctcaacaatggttgcttatgagttttaaaattaaaaaaaggttttaaaaatttttccaacatggaaagttatatttctttatatactaaaacaaaaacaaaactttctatttgaatacctatggcaaaaccctatctctacaaaaaatacaaaaaattagcaaggtggggtagtacacacctgtagtcccagctactctagaggctgaggtgggaggatcacctgagtccccagagaatgaggctccagtgagccgtgatcatagcactgcattccagcctgggagacagagaaagaccccatctcaaaaaaaaaaaaaaaagaaagaaagaaagaaaaaagaaatatccacaatgatctgaaatgcctatctgtatgagactgtcctttgttcacattttttcaagcaaatatcacacaataaattgaatgcaggtacaaatgacatatcaaacatcaaagaaatttgcaaaagatgtaagactgtactaccttgggtttagaaattttcttatcataaaagcatttataacaatattttgtgagcttttaaggaatattttaagtatttctgatttaatttctagtgataaataccaatagatataacccacatacacaaaagctccttgggccctcaatatacttttaagagtgtaaaggaatcctgaccccaaaactttgagaactgctgccttcccctctactttattccttccctagaatttcttccttggaagaaacattcctttgccattctatgttaacttacacagttccattgaggccagttttgctacctctctcccatctttccacatccctctcttgacacaaaacctgaccaaaggactctaccggcccgccccatttccagtgattagctgtcaggtgggctaagccaagaaaatctgggttttccctgagactagacctctctttctgggagatacggaatcacagggacaaggctggccctgtcagaattcatcttgtctaaatgggaagaggttaggcaagtttctagaatgccagactgctttctagaaagtcaaagataattatactttctgccacgactgtgaaaatgcccatttcattgcacgctttctaacatttataccaatctgataaataaaagctggtacctagaagaaaaaaaggctgggtatggtggctcatgcctgtaatcccagtactttgggagaccaaggtgagtggatcacctgaggtcaggagttcgagacaagcctggccaacatgatgaaaccccatctctagtaaaaacacaaacattagccgggcatggtggcaggcccctgtaatcccaactactcgggaggctgaggcaagaggatcacttgaacctgggaggtggaggttttagtgagccaagatcatgccattgccctccagcctgggtgacaagctgagactttgtctcaaaaaaaaaaaaaaaaaaaaaaagtttccatacaatataatttgttccatctctaaaaaccaattcagcaataactgaaagccaccacttggaaggtttcaaggatttagctctacctgttgatgatgtccaaagcattagttaaggtagaaaaaaaatacacacacacacacacacacacacactcacccctatgtagtcagtaccaggaaacacgaaagactagatggtacagtcatccaacacaaagcacacaataactgaaggcactgtagaggagtaacttatgacacagatctacaatattgagtgaaaatgcagattacaaaaaaaaaatctgattttttaagggagagggaacacatacaagcaaaggagaaaagagatgagcagatgactgaaagatacaaaattctgatagtggtacattctgagtggtagaattatcagtattattttctagttttgcctaaaaattttctaaatttcttaagaactttttgttatccatattatcaaatatccatcaccccaggaaacttaaccttgagcacaaactctacaacaagttcaatgtttgttcagtttaatatttaagagacaacctattttgaaagacatctaaaatgatgaccaatatttaaacctatgcattaatatttttcaatcatatccttcacattttgtaattttgataaggttaagctttagatccatcttgaaaagataagttttctgtttgtctttaaaatatgacccacaatatgcctgtttttaaacagtgaatgatgctctaaaatcacaatataaattcaggcagtgctccttacatggaaagtttaagtacttctaacactgctctttttcacttgttatgaaaacacagaacaattatctaagcatctaattattcaggtcctttgtttctcctccaatctattagttttatagtaattttagggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttctgtacctatttttctccataaatccactgagaccaatgtgtggctctatctcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattcttctgaaggctggttatgggacgcattaccttcatactttgctgtttaagaaatgtggggtggagaatcaagtaaactgatagaatttccatataaaattctaagtgctctgagaacaaaagaaacttaaaatacacacacacacacacacacacacacacacacggttttccctactaatcattttaaactaaacaaccaagttgctaaaccagagcccacaaaagcagagtcaaagttctaacacttggtaaaagaaaaatgcacacatacccctgtgagctaaaaaaaaaatgcttaagtattcaaagacagcaattacagctactgagaacatcactgtaagcaaactgaggcagagaaaacaaacgtgctgatgaggatttgaaccacctaagctgcagaaacccactggatggtttcctaggttccgagttggcattatctttcagaacaatcttctagaagagatcacataacactgttacaaaggatctggagaaagggaccctggcttcatcactgtggctctccagtcatgctttacatttggcagtgactatctccattcaactcaattccctaaccctgaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggagcagaaagtttaatagacaagaaagaagaaaggctccctgcggtacagaaaaagggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttgccagcctgtagtcccagctactcaggaggctgaggcaggagattcacttgaacctgggaggcagaggctgcagtgagctgagatcacaccactgcactccagcctgggtgacagagcgagattccgtctccaaaaaaaagataaaaagaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcctaactactaaataaaagctaaactactcacttcctcctagattcagagagagctccaacattttctaaaatttggtatcttgttgttggggtaggcactttttggcaataatgaatagacatttaattagccaatcaaaaaaacttattaggtacagtaagttcctcttcaaaggtttaacctgttcaacttccttgttctttgttcctaagaacaatttccctgtaccttctcacccctatttacctgcttagttatctgctcagttacctgccttgtaaacaactcttcccatcagtcccaacctgtaactcacattccctctcccttccttattagggagaatattcgcgatagcaaatcaagtctgcttagattgtgtagtccgactccagcccatgtgggaatgacagagaggtagggactgcgttagggatataaactcctgctctatcccgctcggtgtgctcttgcattcgtgactaatgcaaacagcagtcttttgcagaagtaagttgtcttgctgagaaaactttttttcctgagtgctggttcttccttgcagcactgatcatttgtttcttttttctttcttttttttttttttttttgagacagagtttcgctctgttgcccagggtggagcacagtggcttgatctcagctcactgcaagctccacctcccaggttcacgccattctcctgcctcagcctcctgagtagctgggactacaggcacccaccactgcgcccagctaatttttttgtatttttttttttttagtagagacggcatttcaccatgttagccaggatggtctcgatctcctgacttcatgatccgcccacctcggcctcccaaagtgctgggattacaggggcgagccactgcgcccagcctgatcatttgtttctaacaatctgggggctcgtccggaattcccattctcctctgagaaaagggtctccagtcaccaatagtgaggagaagcatcccactgcctcattgaggtggcctcatggtgagggatcaggacccacccagtgtgatgaataaacccggactctcagcagtctggaaaggaacagaccaacaacttaagagaaaaggatcctcacataccatggtgaccaggtaactatgtgcacagaccaacgtaagaaacatcacaagagcgacaaagtattttcttggtggttgggatatcttggagattgaaagtgtgtgttgagactcacaattgagtgcaaagcaagtgttcagtccagatctgcagttctgtggtcaccttatacagcttaaggtagcccttctgtaaaggagtctgggtcaggggtttctactgaaacagccattgctaagaggaaaccaatgttcccgtgagggaagcagccagagaaggatgaagcgaaaggagaaaagtgcaagaaacctccagcaggggggttgagcctcggaaaggaaagggaaaggaaagggaaagggaaagggaaaggaaaggaaagggaaaggaaaggaaaggaaagggaaaggaaaggaaagggaaaggaaaggaaagggaaagggaagggaaagggaagggaaagagaagggaaagggaagggaagggaagggaagggaagggaagggaagggaagggaaggaaaggaaaggtgagaaatctccagtaggagaggttgagccttatacaaacctctcgtaactgggaagaaatttctagtaggggaaattgagcctcaccccaatcccttttcaagatgggaaatacctcaagtaatgcaggggagaaaaaggataaagctagcaacaataacattcctcctgatagtcccctagggcttatgctaaaatattgaaaagagagtgaaaggactaaatacaagaaaaagcagcaaatgataaaatattgttgtttcatttggactcaggaatcaatcctgaaaagcaagtcagaaattaactcctctgagaaagataaggtccctgttcctagacagctcaccaacacatggaacttcctccaccaccttcccccgtccaatatccctaacctccttccccctcaagcagaagcagttgtcccagacccttctcctacccacattgttccccctctttataaccctgcctcttgggaattgtcccaacagcctgctcactatcaccctaagtactcttccctgaaaggacttcagtgtgagatagagcaatgtaaaagggatattcagaacttccccttcccctctacctcgggagaattagctccacctctcttcccctgaagagaggtgtccctacgaggaggaggtattcactttgtaaatgctcctttaaccagctcggaggtccaaaacctaaaaacagagttcaagccacactattagacaactccagtggaatagcagatcgaattaaccaatttctaggaccacagttatatatacttgggctgagttaatgtccatcctaggcatccttttctcaggggaagaaagaagcatcatctgtagagctgctatggtagcctgggaacatgaacaccctcctggccaaaacattcatgcagcggatcaaaaattccccaaccaagacccctgctgggacaataataacgcagcccactgaagaggatacgcaagaacttagggaaatgataataaaagggattcgggagtcagtactccgaacccaaaatcttactcgagcattcgacatacaacaaaggaaagatgaagggcctatcgaacttttagacaggttgaaagaacaaatgagaaaatatgctggcctagatttagaagatcctcttaggcagtgaatgttaaagcttcattttgttactaacagccagatatcacaaggaaattacaaaagataggaaattggaaggaccatcccacgaacgagcttcttagagaagctcagaaagtgtgtgtaaggagggatgaggagaagcaaaaagaaaaaatgaaaattatgttatccaccttccaacagggggccccaaaggataaaacacaccagtattactctctgttacccagagacccacacactcccaaacaaagcctcccgagagccaaaacctataaagatcctaggcccccacttcctaagccatataaagaacataaggagacaaagccgagaaacccaaaaatagagagaagagacagaatcaatgcttcaattgtgagaaagtaggccacttcaagaggtattgtcccaaattaaaatcagaaagagaagtcgtcccacttacgacctttgaggaggaataggggggttaggggctctgtctcttttaccttgaatcccaccaagagcccttgataaatttagaagtggaacccaaatccgagcttatgacctttttagtagactcaggagcagcctgctcctctgtttgttaccttcccccacaatataacctggtcctcagaggagcttgtagtctcaggggtaaaaggagagggaatcaaactaaaaattttaaaagaaacagaaattagatgtaaaaactgctcagctaatgttgaatttttgttaatttcagaggcaggaactaatctattaggaagaaacttaatgttaaaattaggtataggtttacgtattggctcagaaggattctacacttcattaaacctgctcaccactgcagaagaaacatacattcatcctgatgtttgggcaagggaaggaaattggggaaaactccaaattccccctatacatataaagttaaaaacccctggagaaatagtaagaagaaagcaatatcctattcctttagaaggcagaataggcctgaaacctgtaattgaaagcctcatcaaggatgggctccttgaaccctgtatgtccccttataacaccccaatactgcctgtgaagaaaccagataggtcatgtcgactagcataagacctctgggccatcaaccagacagtctagactacccatcctgttgtccctaatccttaaaccattctcagtaaaattccatatgaacatcaatggtttacagtaataggtttaaaagatgccttttgagcatgctccttggatgaggacagctgagacatttttgctttcgaatgggaagatccccattctggatgacagcaacagtatcgatagacagttctaccccagggcttcacagattcccctaatctctttggtcaaattctagaacaagtgttagaacaagtttataccccaaaatgtatatgtctgctccagtacgtagatgacttattaatatccggttaggctatagaaaaggtatctgctttctccgtccatatccttaaccatttgtaaggagaggggctatgggtttcaaagagaaagcttcgattcatagagcctgaagttaaatacctaggacacttaataagtaacggcaaacgaaggatagggcctgagagggttgaaaggattgtatccatacctttgcttaagactaaacaagaactcagaaaattcctagggatagctggatattgccgcttatggattgactcatatgcccttgtcataaagcctctctacctaaaaatcacccaagaaaagcctgaccctctcctctggacttctgaagaactccaccaggttgaggagctaaaacatctgcttataactgcctctgttttagctttgccttccctagaaaagccatttcacctttctgttaacataaataagggggtagctttaggggtccttacccaagaacacggaggtcaccagcaacccatggatctcctatccaaaagttttagatccagtaacctgtggatggcctgaatgtttcaatccattgcagctaccgccttgttaactaaagaaagcagaaaactaacctttgggggaaagttagttgtaaacatgccccatcaggttagagccatcttaaattaaaaggcaggaaggtggcttactgacttgagaattttaaagtatgaagctatcctgttagaaagagatgatttaacactaaccactgataattcacttaacccagaggtttcctgactggagatccaaatctaaagagacctgagcatgagtgtttagatttaatgatcatacaaaagttaggcctgatttaagagagaccccttacaaaacggggcagggcttctttatagatggctcttcccaagtaattgaaggaaaaaggcgtaataggtactcagtagtagatggggaggcacttgaagaagtagagtcaggaagcctgccaaataattggtctgcccaaacatgtgaatgaattgtttgcattaaatcaagccttaaagcacttgcaaaaccaagaacggactatttatactgattccaagtatgcctttggggtagctcacacctttggaaaaatttggactgaacgagatcttattaatagcaaaggccaagacctgggccacaaagaattaatcacccaagtattagataacctgcagctgccagaatagctattgtccatgttccaggacatcagaaaagtctttcttttcaaagcggaaggaataacctagcagatcaaatagccaaacacactgccgtttcctctgaaaatgcctgtttttcacttagccccttgccttcctccctcgactgcagtccccatcttttctcccgctgaaaaggaaaaattaataaaaataggagccaaagaaaattcagaagggaaatgggtgtcaccagaccaaagagaaatgttatccaaacccctcatgagggaaattctctcccatctgcatcaagggactcattagggacctcaagctaagtgtgatgcagtcctcggggtctacagatgtataggaatttatattttggcaagacaagttacagatagttgcctagtatgtaagaagactaataagcagatcctcagaaaaccacctgttggagggagaaatccaggattaaggctgttccaaagtgtccaaattgattatgctgaaatgcccccaattggtcacttaaaatatttattagtgatagatcaccttactcattgggtagaagctattcccttttcaagtgcaactgctagtaatgtactcaaggcattagttgaaaatattatacccaggtttggattaatagaaaatgctgattcagacaataggactcatttcactgcacatgttcttaagaaactagcccaagtactagatataacatgggactaccataacccctggcacccaccttcatcaggaagagtagaaagaatgaatcagactctgaaaaaccacctaaccaaattagtcctagagacttggttgccatggactaaatgcctccccatggtcttgtgaagattccaaactgcccctaggaaagatgtcggctcacctccttatgaaatgctgtatgagttgccttatctacactccactgctgacattcctcgttcgaaacaaaagatctgtttctcaagaactatatacttggtctatcctccactttctctttccttaggactaaaggcctcttggcacatacaccaccccttaattttaccaattatatatattatatataattttatatatataaatttctatatataaatatataaaatcatatatatgatatatattttttcatatacatcatatatatttacaaaaattatatatcatatatcatatgatatatgagatatatatcatgatatatatgatatatgatatatatcatatgagatatatgatatcatgagatatatgatatcatatgatatatatgatatagatatcatatgatatatatataatatatatatgatagatatattatatatgatagatatgatagatatcatattatatatgatagatatgatagatatcatattatatatgatagatatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatattatatatgatagatatgatagatatcatattatatatgatagatatgatagatatcatattatatatgatagatatgatagatatcatattatatatgatatcatatatataccacatacatcatatatacatcatatatacatcatatatatcatacatatatatgaactttccagaataggtatatcaataaagacaggaagtatacaagtggttgccacagcctgagaggagcagggaatggtgagtgactgctaatggatatggcactttttttggggggtgatgaaaatgttctggtcagacaatggcaattacaaaactgtatacacacgaaaaaccaaagaatcacacactttaaaagggaggatttagctcggcatggtggcatgcgcctgtactcccagttactcgggaggctgaagcaggactgcttagagcccaggacttcaaggctgcagcgagctatgatcgctccactgcactccaacaaggatgacagtgcgagacccgttttctaaataataataataataataataataaataacccaaggtacccagttcacatgcaaaaccactggtaaacataaattatctccaagtaatctagaaagaaaatgagcacataagacgtcttctaaaaacacacatatatttctttacatgttacatttaacgtaaaaatcagctatgcagaagttacatgaacattttatgttggaaaggtaaatgactattattaatacagaatggttaagtacatttatgtttttatgtacaaacgcataaaaggaaaagcatccttaaaataaacaccatcaatggctcctcggtggtcacaaaacaaaatcctcacacctttgtcttccttcacaattgagctttatccaccttttcaggcttatctcccattattacctgacacaaacttgggtgggccagagtttccactgaccatcccccgactattcatccaacactatgttcactgcctcccattcctgaccatttgccttttgtcttcaactaattctggggacgttttgtccaaataaatgatccatattcttgaaggctggaatcaagtcctattacaaatatattttctcaccctctccagagcatagcaacccagcatctactagcctctcacagctctaaccatccacaaccctaagctggcttctcatcaaacgggtacttttcaccacccaaattcaattaattcactcttacaataatgaagaatagtcgcctacagcctaccttttccagccttgattcaatcatttatcaattttatcttcaaagtccctcacttcagggagatgatatatcagctttcacccagagtcctaaagaaaacagcactcttgccaatgacatagtgccacctagtggcaacataaggtaaatcacagtggcagtagaaggatctccacactacttttacaggaatgcactgcaggtaaaaaataagaagctacagtactgtttggcaggacaatttgtttcatacgtgcatactatcgccctgactaaattaactcgcaagtcttacaggtattatttgttttcagttccatgcacagattagccatttagtacttactaaatcaaactcaatttctgaagtgtcttacaccaatatattcatgcacatatggttaaaattttccttgaggatctatcatgtgagagtgtggcttattataacaagtaaacagaacaaataaatacaaaatgaaaagaaatcgtatgatttactcgcatataagggagcttgttgtggattaagtttcatgacccaggacactgaaacagaaatggaataaatgagaataaaattaaaagttgtcatcaaaaatatagaagccatctaaagacctaggtgtcaagcatagctctatgagtacaatcccgtgcctgagattaccatatgcccagctgtatgctatacactaagagatttaggaaggaagcggggtcagggattgaccccagactccatcttttcaagtggggaagaaagatcttccgattgaaaaataaaggcaaaaaaggcttcaccgtcacagaagtttcaacaaccaacaggatatttaaaacagttatcaaagcaaaaccattgtatgttcacttacatttttacatagtccctcaaactcacaaaatgctgtttactcagggacttcttccggtcttactagggagcctggaaagtgacgggaggattgcaagggaccactagaaccctcttcctcaattccccttctctgagaagggaggctacagcttgcctctctaaccactaaaaggcatgaccctcctcaaagttaatagccggattccctgatagatattttcactaaatgaattctcataaaactctcactaagatttagagaaggcttccagggttgaattcctgaacattaagaacagcatgttttttaaaagtttaacttggtgattggaccaggacttcatctaggctatgaatgctcagaatggtaggtcctttaccaaacagcttgagtttgtgtataaagtgatctcatcctcttaagagtcagagaaacagaaccaagcgacttcactataatttgatctgaggaagtttcttactcacaataggtaaatgaaggcacatactaaccagcaatataaacaacaatatcaagtgtcattcacacatgcaaaaaacagacaaaatcccaaactctgtgttctaacaaatcgcaaaaacctcactaacaataaattgaaatgaccaaatgtttggactgaaaagcaatgccttggtagcctagccatgcctaactcaaataacagaaccatctcgatgttaaaatcctcacagatcaagctgtgtatgtctcgggtcaagacttcgccaaaaagcagtgagcacacacttaagagggaaaaaatctacctcagcctcctaaatgcaatcatctctacacgagttgcaggccccaagcttcaacgtgttctgctggacaacgcagtagaaagctgacaagcaggtggccttcccacactgactgaaccacctccatgcccatgtccattcattttcttgcccaccccatgtgctataacagacctcctggctcagggcactctttccttcctgactgccttcacttaatgactttgtacttttaggtgcaaaaattatctgcagaaatccacactgaaaaccaagcttgagaaaggcagcaataaccaacatttttacaagaagaacaaggtcaatatcaagcccatcagattcaaatagcaagcatggatgaaaatgaaagattgaaaggcttgagtgccttcttaatgtattaaatatccatttaatttacaattaagctcactgtgctcactggccttttaatcagctttccaggtcctgctcagacttgcctaggacatgggaatgaaagaacctatacatttatggaccaatctaccttaactaacttgtcaagtgttcctgcatcaagcagaagaaacatcagtgaaactgatacaggaattaaccccttgttaatccataaaacttaaaggagcgggatccaatcttctggcttccctgggccacgctggaagaagaattgtcttgcgccacacataaaatacacgaacactaataatagctgctaagctttaaaaaaattgcaaaaaaggaaaatctcataattttttgtttgttgtgaggtggagcctcactctgtcacccaggccggagtgcagtggcaccatcttggctcactgcaacctctgcctcctgggttcaagccattctcctgcctcagcctcccgagtagctgggatgataggcgtgtgccaccatgcccagctaattttcgtatttttagtagagacggggtttcaccatgttggccaggctggtctcaaactcctgacctcaggtgatccacccacctcggcctcccaaagtgctgggattacaggtgtgagccaccgtgcccggccaatgttttaagaacgtttacgaatttgtattgggccacattcaaagccttcacaggctgcatgcagcctgcaggccgcggttggacaagcttggattagagaaatctacagagacaaactagtgacttagtagccctctgatagctcatgatttgcaagaaacttaggatgactatgtgtaaagaccacaaacatcaatttaactgaatggttcccgccacactggaatgaggaagctgagcaaactcagaggactctaagaaagggctgatgtcatctgaactgttcggaattataaactcctctaaacatgtttcaaagccagaacttgtaggagttgttctgatacacggattaaaagagggatgacaaagtgtctgtcccccacactggtcaaagggacaggtcattgttatgctggcaatgcaggctgctgaaaagaatgtatctgtcaaaagtaatcaaagtaatgaccccagaaggctccagaaacagactggtaaattcaggttgctttcagacttccacaatgctggcacacaaggggaaagacaaaactaacatttacagagcattatatttgatattacatttaatccccattaaaaagatactatttcccgtttcactagtgaaaaagttgatctttcaaaggttaaattatttaacaccaaggtcaaagggtaagttggagagaccagattcaaacccagtctgacattaaaacatgtgttttccccccacatcgtctcctgctaataacctcaaatctaaaaactgacttgccctacaccttgagccccatcctacaaactctccctgacgttattaattcagctgtcactgtgcacctacaacgtgccagacaccatactcctcaacactctgtaggcacagaaggaacagataaaaatccctaccttcatagatattattctaggggtaacacaggtaaataaaacattaaaatagttttcacatagtagcaaattccatatagcaaaataaaacagaagaaggaatagcaaatgagggagatgccctcttaaacatggtgctgagggaaggcctccctgagaaagatatcatttaccccaaaaataaaaaagcaagtaatagaaaaaacaggtaaaaggtgttctagacacttaaacctgccacattgagaactcagggttctgatgcaaaacctcgctgcatagaatgcattaacttatttttatacatttaaacaaacaaactctacttaagaactgtgttctaaaggaaggagcatattacaggaaggcaatttttggtcagagtagacacacttaaaaactaaacctattgaaagaccaagaacaactgaaagtctttgctttgtcagatttttgaccaaaaggaaaattaaagaaacacaccgtgcccatccaatgatttcaccaaggaattttaagagagaaaatcctacttcttcctcacccagtagccagtgaaatgactgagcaaattcacaagttcactggggctgctttcatgtaacacagggacaacacatgacagacacagtggaaccctacaggttgcctagtatttgaaagactgtgaagaggaggagatgtcaaaattcaaagtcttaaatgatgtagttttaagtatgttcagcaatttcaccactcagtagtaaagccagctacagttgaaagcaatcagaaatttgaggggtgtgaaataagcagaagcacagaagttaaggatttgtattcttcccacattttccactttattttatactgctgagaaaaaacaaatttaatagttttctgctgtataagagagacacattcactttatgtcacagtaagagtcactcaattttaatacaactatctcaatgtataaattaacattctcccccctgcccacacatagtaagtctcttatgatgttgctgattagagaagcaaaagttgccgctacaattctcttcctgcattttaatataaacaatcatcagtcttttcttcatagagtgcagtgtgggcactatcatcagaatgtaccagcactgggtgtgcaaagtttacaaagattagcaagagcaaaagtgttgagatttttgaaattcatgctgctgcaaagaagtatgtaaaaactcactcaccatagaggaccacacagaaactcaggcatgaagttatatggctgtgtgagtggtttgggagaaggaacggaaagcacttccaccaacctatatgcctgagcaaattaatgcaaaacctcagaagctacaaaaaagtttatctacctaaattaaaattggtgtccacagcagtagccagcaaaatgcctgcgaagcgcaaagtggtaaatattttagggtctgtaggtcatatggtctctgttaaacaatatgtaaatgaatgggtgtggctgtgttccaataaaacttcatttataaaaagaggcagcatggtacatccagtcagcaagctataatgtaccaacccccggtctaacactaaccaaatacctcttaataagccaaagaaactgtgtcctcttaggccggaagcggtggctcacacctataatcccagcattttgggaggccgaggcggggagatcacctgaggtcaggagtttgagaccatcctggccaacatggtgaaaccctatttctactaaaaatacaaaaattagccaggcgtgctggcgggcgcctgtaatgccaactactggggaggctgaagcacgagaatcgcttgaacccaggaggcagaggttgcagcgagcctagatcacgccattgcactccagcctgggcaacaagagagaaactccgtctcaaaaaaaaaaaaggaaataaaagtatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagatttcaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacacttttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcagtaagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggcgggtggatcacaaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatgtgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaaggggggacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgtgcctgcactatgttaagaccactggcaaagagggtacaaagttaaataaggtctatcacagccctcaaggagttaaaggactagaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaaatgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaaaaaaagaaggaaaatttgagggtttttgattttttcaacttcacataccggtttgcctttgcaaaaaaaaaaaaattgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgctccggctccgcgacagctctgcacgtagccccagccaccccgcgcaccggctacaagccgcccgggggtggccggggcacgcaagagggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaagtgatcacagcagggtggctggcagagactgctctgggaaatgcccactcacggtctcctctccgccctgtttctagaaactgccctttctctgtgtgctcgtggttacctgagctgtagcatttaaccacacatcgtgaaatgatttactcctctatttcccccacttcaactcaggaagtggggtttagtcttgtgtgtccacagcctaggacactctaaggtattaggtattaaatataggtattaaacaagtgttggatggatgcacggcgctatggcggaatcacaattgtgacagtgcattccgtgaacttttggctactcgatcaccacagtcgttccgtgttcaagctgcaaaggacctcagaaatcatcggattgctttgagaaacaaaatgtggtccgtgtaccaacggcggccgaggagaatatattagttggtacacggagaaacttcttttttcaaatagttaagtgttttagtgctcattaggagggaaatgcctatcacgtcaaatcattgtttcattaatgttacttcttaggtcaaataaaaagtggcaaaaaacaagtgtatttcaagaaaagtgttaagtgaaacttgagacactttatatgcagttcaagaatgtaaaatactagttgacagtgcttgaagtaagaacagttggttaggtaggaggagaagattattggctgggaaggaggaggagggaaccctctgtggtgctgattctgtattttgacctgggtgatggataacaaaagtatgtacatcaataaaaaatacatccagtgcactttagattagtgcactttacacattttatacatgtatttttaatgtcaattttttaaaaatctggtatggaatatacccccacaacccccccccccccaaaaaaaatgcaaagatgcaaatgactgccatttgggaaacactgatccaggcaggctcactagcagtgaccaaacacctgagaaagggtattgtgaatacctgatgtatgtgccaggaacttccatggttgaatagctccaaatctcagaaatgctcctaacctcgtgttgagctctggtgcatagatatattttcttttctttctttcctttttttttttttttttttgaggcagagtttcactcttgttgcccaggctggagtgcaatggcacgatatcagctcactgcaacctccgcctcccaggttcaagcgattctcctgcctcagctgcccgagtagctggaattacaggcacatgccaccaattccagctaattttttgtatttttagtagagacagggtttcactatgttggccaggctggtctcgaactcctgacttcaggtgatccacccacctcggcctcccaaagtgctgggattacaggcttacaggtgtgagcctcagcacccaacccagaatggcttaaaaaaaaaaaaaaaaaaaaaaggccaagcatgcccagttcttcatgtgaaattatttctgtatcacctcatcatgctgctcaccctcttccactgttctctaatctgtccttgttgatatttaaaagctggcacaaggccgggcgcagtggctcacacctgtaatcccagcactttgggaggctgaggagggtagatcactagagcccaggagttcgagaccagcctgggctacaggtgaaaccccatctgtactaaaagatacaaaaattagccaaacgtggtagcccaaatcccagctacttgggagaccgatgtagaaggatcgcttgagcccaggaggagaggttgcatgagccaaatcagcagggcagctgcagagtggggtgcaaggtcctcaacccagaggttccctaggccccacttgccccagctcatgagagcctggttctgagctctgccaggactggggctcagcactgcccatgaaaacaggcgtggcagggaagaaaatcataaccaaatatttgtagtcacctctctcctcccttctggaaagggaggttcccaggtttgtgggctctttgcctcctggacattattgtgtagtgaagggagaaaggttgagatgcagagttggagaaactaagagaggccgaactggtccatttgaggaaagatgactgatcccagaaggggaggaggggacaccctggggaagcaggggacttcccacgtggtcctagaaggggagggcaggatatagaaagtcagagcatggttttgagttttggagacaacaagagaaaagagggagggatttggacaactatggagaggactgggctgtggagagaaatgtttagagatttggaagatggtgtgtcatgcgatgtattgtgaaaaccccttcttcatatccctaaaagaccaccgctgatggtgattcatggtacaattgatgattgtatcatgatataattcagtgcttttgcagagggattggtgcctttttaaaataataatgatgctttggcttggctccatctgaattagtagagacagacatcttgagcaggttttatcagagttccattagctaaatattgggtttcctattttgtggcttgctttaaaccgctttgtgggcccttccgcactgaaagccactacagaaatcacctctttggtctgcagctccatgtccccaagctctgggctttcctgaatgagtggcctcattcagaagataatacagcatccctcatctgaaaatccaaaatctgaaatgcttcaaaatccaaaactgtttgagtgccgacatgatgttcgaaggccagattcaaaggaaatgctcattggagcattttggatttcagattttcgaattccaaaatctgaaaaaaatccaaaatctgaaatacttctgtaatttaacctgtaatagacattgggtcctgaccttccagctgaggcagcaagcagtcaacagaggctcaccatgcatccctcctgctcctcaccctcccactggcttgtgcctcaccccccagcctcccttgcacctgctgggaaggggacaggatgctcctgccctgccttcttggatctcaggctactgtgataattgcaggattccagccagggaaaatgctacaggtagaagtacttggtactctccatagagaagtttccagcaatggcacagcagccccgggaagtgtgctgccacacccagctaattttaaaaactttctgtagaggtgtgaattcactatgctgccaaggttggtcttgaattcctggcttcaagtaatcctcccacctttgcttgccaaagtgctgggattacggcatgaactagagctcccagccgagagtttagttttgtttgctagtggtgttcttggtatcttttcatatttgaggctttggtgctagtgctgaagtattacactcaccatccgaggttggcaggacttttgtttcagtattgaacagatggaactgtttagttcttcatctttgcaggtataccaaatgtgcctaccaggagtctgctttatagccattgaaaagcaagaagtaatatagtaaaattttgcctggctagaggctttggaagacaagtattttggcttaattctattaacttggaaggatgaaggtgaaaaaaaattcaaaactttaatttcctgtttattgccatttgaaaatatagccaatgattccacttttcttctccagtaagtttggacattctgatctacttggtgttttattatagaactcctagtgtgcctgagtcttacattgtgaagatccttctctaaaacttcacatgtaagagaatataaatgatattggataagatcaggctggatgagaactgatacctgtaaatatgcgatttagacgaaatctctgattgttttcttatttaactcataaaaataaaactcattggctggaaggtgggagcaggaaggagatttatgtcttttaattgcacgtcattgtttcatatagagacagaacatatagtatccctggttttggacctacagaatgaaacacatttttctacctgctgtatgccagaggttcttgaacacctggagggattactgcagcacagattgctgagccctactccagagtttctgattcatcaggtccagggtggggcctgagaatgtgtatttataagaagttcccaggtgctgctggagctgctagtccagagactacatttttgagaactgctctcatatactaactgtaaattgcagagctctagaaaaaaagcttagtttggtgtgggataagaagcacacaggttatggagaaaatcatgaaagattcaacccttgatcccagcctagtgtggatttcaggtaacaagcaatacacagtgacataacaaattcttggttttcatgactgcaagtgagagccaagtatcaagtgagaaattcagcttcatttgcaaggcttagagaggccaggtgattctagaaaaatgggccttgtatttctcttaaaccagtaaagagctttaagtggttattaaattgaaagctttgtgttcttacttattttgtattttattttatttcttttgagatggagtcttgctctgtcgcccaggctggagtgcagtggcgtgagcttggctcactgcaacctccatctcctgggttccagtgattctcctgcctcagcctcccaaatagctgggattacaggcacccgcaaccacgcctggctagtttttgtatttttagtagagacagggtttcttcatgttggccaggctggtctcgaactcctgacctcaggcaatccacccacctcggcctcccaaagtgatggcattacaggcgtgagccaccgcacccggcccaaaagctttgtgtttttaaagatattagacatgtttcttgtttttaaaagaaatcttaacaataatgtaggagaataagacaaacatttttccaaaaaagagaaattgttgtgattattttgtcttattggaatgtcggatactatagtcggcttcattaatcatcaagcatgctatggattttccatttttataggatctatatctcagttaaggtaatactggtaattcttgtactccatttgaagatgaaaaatataggccaaaatcacagactttgcacagaagctgcataatgaagacagctctggaggaacacatagatacacacacacagacacacatatatataaagtatatacacatatattttttaaagtttattttttacagttttaaaagttttaaagcaaaacccagcccttcccctctcccagagtgggcggcccctcccctttctctgagtgggcggggacagcggttgcatgggcagctttccttatgatgccacaggtccctctggacatgctgctgcctggccacgcctcctttccctttcatctttctcactgaccaatgggcttggagcattaaggccacgcccctattctgcgttccattggtgccctggttacgccacctgtggctcagttgcacagctgcctggtaggtgactggaggcattgagcagtgtgctcactggtatttcgctgatgtggccccaaccccgcctccctccccaccccgcgatgtcagaaaaaacacaacaggggaaattggccgcagccaagaaaaaggtaaaacacaccaggtcatggcccccaacccagccacagatcccctccgatgacaagaccggtgccagagtccataccactcctgaggcataccagatggggccccccaaccccagcccctctgggctcccccaaccaaagcctagtcagtcagccccaccccttcagcaagcagcccagtacctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactccggggctacctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccggcctttgatcttacaacccagtcccctaagttttctcaccccatttctggttcctctggttgcagcacaaatttccagctggaaggggagtggagactatgggacctaggagcaagaggtttcaggctgccttactccctcaacatagacattgacagtgggaaaaatcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgtgggacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtttacttttctacctctgcccctggttttggtccctggaagctgctgattcatggcaaaaccccagagcttggagtcagaggactgagtttaagttccagtattgccttttttgatctttcttttttttttttctatccatgatatcaatccctctcagtcactaagtgattgtgacaacaccttgtacagttgttggtggcattacatcagatggtatataagggtattttgtcaaaactgtaaaggaggatgtggctgtaggggctgatcattctcatgagtgttactgctcttctttcccacagttaaaagcatattggcagaggaagagccctggcattccagcaggagctaacaggaaaaagaaaatcaatggcagtagccctgacacagccacttctggtggttaccactcacctggggatgtgagtctcggcgggccagggtcctggcgacagggggcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaagggtccaagataggcagaaaagaagcttttgccagttgatgggggaagaaagaagtcagagggcttagacagtgaggggggacagaacatctccatgtgcactctcatctcttgcagtcagcaacaggtatctacggagaaggccgtgcatcctctactaccctggaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatcttcctccaactccttctctctgcatgcacctcagagccagtaccaagaactagcagtggccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgtcaggggtccatatttctgccctgcctcagtccctaatttgctttttgagtctggacaagccatctctcctctttatgctcgtgtttctggaggaggtagagagtatcaaaggtcttggttagctctgaaagtcagagatttaaaggcccctagaatggaaacctcagggccaagggctcctgtctgtcctttgctgttttatatctctgctatgaagaactgtacctggcctgtacatgctcagtaaatgtttgttgaatgaatgcacgtttctaaatcacaaactggcagaaggggggtgggcccttctcaaactctgtctctagaggttcaccagcccctccctccagggcccttttccccctttgctttgggcaggttcgcacatctaaggaggagaagaagcatgagatacatctggtacagaagcttgggaggagcttgttcaaactcaaaaaccagacgggtaagatggggctgccatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcagccacccacagtgctctctatctgaaagtgacttggaagactggctaccatccgggtgtgaggagtcattagcagtgaggccaagtttgggaagcctgagaggaggagctgtgcaccgaagggaggatttttttttttttttttttgagaatccagaggcccttattgtctgcttcctttctcagctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctgtgtgaacaggaggagaggctgtgtgaacaggaggagaggctgtgtgaacaggaggagaggctacgtgaacaggaggagaggctgtgtgaacaggaggagaggctgtgtgaacatgaggagaggctgtgtgaacaggaggagaggctacgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcggcaggaggagcaggagaggctgctggagagggagaggctgctggacgaggtggaggagctcctggacgaggtggaggagctcctggagcaggagaggcttcggtaacaggatgagaggctgtggcagcaggagactctgcgggagctggagaggctgcgggagctggagaggatgctggagctggggtgggaagccctgtacgagcagcgggccgagccacgcagcggcttcgaggagctggtgcgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcgacactaagttctggggtctccagttttagtgggtggccactgattgcttctctctgtccagaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcggggtgtggtggctcacgcctgcaatcccagcactttgggaggctgaggcaggacaatcacttgaggtcaggagtttgagaccaacatggccaacatggtgaaagctcatctctactaaaattaaaaaaaataataataattagccgggcctggtggtgcatgcctgtaatcccagctactcaggaggctgagacacgagaatcacttgtgcccgggaggtgaaggttgcagtgagctgagattgcaccactgcactgcagcctgggacacagagtgacactctctcaaaacaaaacaaaacagaaaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttacatgctgggaaaaaggacgtgagatttgatgctagggaaggaggcatggggttctaagcaagggagacagtctcttaggcctggagcaaggggccaggggcctgggcaggccacagagccccacagtgccctcgctaccctattaatgggccaggaatctggaagccagccaccacatgtcctcatgcccagggtcttccggcaggtggagctgaagagccaagaggctccgagtctgcagcagcagccagaccagtagctggagccccagtcccacaaggagcttggatgtgcggacaagcagggtggtgagtagagccctcaggcggggtgggcaggcaggagcaggggaggctcgcactgtgcccagattcccaccccctccctctctctgaagatcttagtgagctgagcctcactgatagcatggaggctgcaccgggacaggacagggagggttctcccccatgacaaccccactgcacagcagatccagcagctgcttcctctaatgcaggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttaaatttatttgtttctaatttatagtttaaatttatttgtaaaaagttaaatgagagtgggtctttctctcatgttcactctggcatcctttagcattttttaaatttgataattataggacgttagcatgcatatcgagtttgcccttatgtggtgggagttcaaacacacaaagacccactgtatgcacacaactgttcttgctggtttgggataggctgccatgctttttaaatgttagtacagcatgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagccttttcccctttttctgtgtattggggatgggagtaataacattttggggagctttttaaatctcccagaagaggaaagtggcctgctctggcaggtgtgtgcaggatagaatatgtttcatttgttctggtgccaagaatgagcgctgtactatggtagttcccttaggatttgcatgtgctctgggctcatgaagacattgcatcatgagctgtggcagttgtacttttttttgatgacctaaaaggggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtattcagtaaagatcagaagaaatcctttaagagtttaaatgtccctgaaacaggcatatacaggctctagtcaagaatgaattcgagtgaaggaaagctgtgttacacctggcattcctctgtgttcatggagcttatttgaggctagaagatggattttaccatctagacctctctggctaatagctagtcttcaaccatctgacagaggaattctttttcttgaatggaaaaggctttaaaaataataacaaacattattataaacaaatatatgtgagagtacttagttgaaacaaaaaggaattttagtagacagtattatactacatttgaaaatcaaggagcagtttatgcaacttaaaatgtttacaaactgcagcgcaatctactgtttgtgaatgtcaaagtgtcatgaggaaagtgtctatacaatcacggagttatatttcctcacaaagttctttacgaagagtgaaatatgtttttataccttttggtttcagttagaggcatattttgtgtaatatttatgttaatgtgcatgatcaatgaattatttcagtcatatgttgcctatatcataactggaggatgcttggggaacaatcaacagctaaaacttcatgaagttctaatgtctgtgttccaaaatacatcatatcattaggatgtagggagagatgtatctgcactccctggggtgggcatttctagttactagaccatctccacttttagcattgggcatcctcatgatacttttataaatatgacattaataggagatcaataatacgattttacagattgaataagagaattgcctgcattcacttaaagattgcaaatattgagcccttgtgacttcaactgactcttccaaattgtatgaatttatcaatgtattagagaaactcagtttcagaatgataaagaaaaactggtagaccaagcaatgtggctaattaacagtggtaggatttccagcccaagggtttaaaatggacttaaggtcctgttcttgccttttattttctgaacttgctgcttttgcattctttgagttcagtttaaagacagttcctttaagtccattttaaaccctcaggctagaagtcataccactgttaattagccacattatttgatctaacagtttttctttatcattctgaaactgggtttaccgaatacattgataaattatttcaaaggtatttttatagttcaaatcacttcacttttaccctgacacgtataaatgactaggaatgaccttcggatagcgtttagcatctgtaaccaatctgacaataatgtgttcatcaggtacctatggattaaatcacatacaggcatatttaagctgaacgtcagtctgaaaaataaatgtactatattaactgaaataccactcttcatgtaggtattttgtcatatgtttaagaaaaagctaaaaagaatggaaatcatgtgacaataacttaagtcttccttcaaagtgcatgcagtcttttgcagtacctcattcagccaagtatttgttctcttcctcattcagtataaggcagctttcaatttgcttagaaggcaacattagaaggttagagttcatcagaaacagaattttaaaatatgagttcaactgaataaatgtgaatttctgtaggaagtaaagaatcaaaatacctatctaaagatggcaatatataataattatttttaaagtatttgattaaaccagataggttttctcgaaatgaaaaaaatcagttctaaaaccaaagatgattttttgaaaatgtgaaaatgtaaatcagccctatccataatataatttctctaaaactgtatctgtcattttaaaataatataactattaaaaaatgtaactgctatcttattgttttgaaataagttaaaacattttaaatatgaatactgcagtttaaaagaaagaaaccaggggaaggaaaagtagagaaagaaatgccaattccagtccaaagctttatttgccaagttttcttagaatgacttttacctatttatgaattcttacaaacagaatgtataatggaaatactgacttttgcctaaagtggcattgttgactgctgtgatgttactgtaatgtaataaattattaaattgttgcaaagtgctgtttttgccttaaaatttcgtgtgtcttgaaaactacagtattaaatactatagcatgcaaataatgggcatgcttggcatgagataatctgtttttattgttacaaaattgtaactatgtaagtgtgtttattaaaagaacaaacaaagttatgggatgaaagagttacgggataaaaaatgtggaaaagtgtgtcaaaaaaagtagaaaaaattgtatgaaaagttatttaaaaagttatggaaaagaagttatgggattaaaaaaagtcacgggatataaataaaaataaataaaagcaggccccttccagcataagcctggagaagtgggtctggactctccgcccccaccatgtccctaccaccccttcccagtcagccctttaccattagggtagcaagacccctgtctaatggggggagacagaccctttgccaccttgaccagggctgagtccttaaatttctggacgatgatgcttgttatttaagagccagaggctggtggagttggtttgtttggagtaggcctgatggcctctctactcttgccaaagcaacttttccctcaggggagctcccatcttcttattcagagaggcagctgaggcaggacagtggggctaacagtagaccaggcaagggcatgggctgctggggtgacccccccttccccagtgtatatattgtatctgcgtaacattttgtatattctggggagtggggctgcccctgtatcgtacctagtggaggttggagctggcatatagggaggaggatctaataattatttgcatctgggaaacgtatttattgctagcataggacataggaaggaggcggggatggggtcgtggctcccttggtgatgcgactcctgtttattttgcttttcattttggaataaatggatttagccatactgctcagcctggtgtgttcccgtttccttcactgggtcctggagtttgtcccactgaatgaggagccccagagtgtctgagcatgtccagctgggctgttggggaccttccaggcctgttacctgtatgctgcctggtgacacctggtggatttcatggggactgccatagcacctatggagcacagtacggccctgacagccaacaggctcagaagcctgatctagcagtggccgggaagtcagataccagcacccaagggcactgacttccatccaccccaggcatcttcccttccgtccccttgcctccttctcctgtctgcactgggtggcctgttctgtctgtccctccagaatgccggctgcccctcagtctccctccaggctgagatcatgaccctgacccctagtggccggagctggcttcacaggataaaagccagctaagctccagggactttccaggaaaagtgtcccttggaaaggatgtggtcttttcacttgctcccaacagcacctaaacatggcttggcctttcccctcccctgagctccacagagaacacagccagcagaggacacattctccgtcatccggaaatgggtttgattctcagccgagggacagcaggactggtagagactgtcaggccacatggctgcctgcacagcacccccatgcttggtggagggtgggagggatggcgggggctggctgtccacaggctgggcatgacagggagtctcactggaggtggcacactttggaggggcgatgtcaggggacagctttctcttgctggaccacaagactccaaaaggacagcacagggacttattcttagtgctagaggcgaggcggtcggccatgtgtaactgcatatatatatatagctatttatagaacagggcaggggcataccacagagggggcacaagttttcagcaacggtcacacctggatgtgtcagctcaccactacaacagactaagtcacagatgaagagggctggctttggggctggagagccactgtcaagtcatagtacacctgctcaggcaggcttggaaagggaagtctccaagtagaggagggatctgtttagaggtcaaagtggggcctggggctctcaggacgggatggacttgcctgacccgatcagctggcaagtggagagaaagcagagagaaaacaggagagagaaaagcaagcggattgctggtgaggcaagtgcagagcatgggagtgacacagcagctgtgggagggctggggacgggagggcacaggtgcgggtgtgtagtaaggttcctggaaaaggggctggaagggaaaggggaggaggatggagggggaagccggagcttcacaggtagtgcctgggggctgcagcggccctccccaccccacacacgcctctcccatggcatccaggcagtgcacccacagttcagaccaatgctcagccccgtcaggcttcccttttctctggtcaccctgtcttccaacccactggcccagggccacccctcgccttggggagccccaagcaacagccaccaggcctgatagggaaggaacactgcttgaaccaggatgatgaagctaaaagggatggatggttggagtgagcactggaggcccctttgggccatcagaaagcccagaaccctctgagaggaccctgggggaggcagggagggcaggcagccagatgccactggccatagacttataagtctaagaggggagcctcagcttgttgggggactgcaggtcacataggtgaggctgggcccttcctgcagggaaaagcagaagagggagagtctgtggcaggagaggcgggcaggctcactggacagagctcagctgggccagcaggcactgtggtccccttggttgaatagcataggtgacctctaggagcaacaggccaaggtgcatgagccaactggctggcagtagtgcttcagcgggggccagggaccctgccttcggtcacacactagcagctgtgatggtatctgggagggagagatggggtctgtgtgtccctgcctggcctgtgaagtgtgttgtgggatgaccgtgtgtataggactctcaggcttttatcctagatcaccactggattgctgacagatagaggaagtgggaccctgactatcacccctaatctggagtggatttggctctcggcactcccaggctgggagctggatacctgccctgcagcatgactcagactgcacgacaggtacggcgtgcccaggatgatgttcccaggcctctggctgcctcagaatccagcccaacacacacccccctccaagctcccagcccccacaccataaaccacaagctctctgccctctctgatggctccagagagcacccacatctgccagcttgggcatggagcccgttccaagactccccaggctcagtcatggaggctgggggactttgggaccgtgggggccggccctggtacctgcgtccagccaggatgctctgcacctgcagccaagagtcatccacgggcccccatgggcatgctgatggtgatcatgttgatgtcgctgatgctgctgagcacctctgtcagcatatggtgcatgcacagcatctcatcgccccgctgtacctgctctgcagactcctccatcagcgtgttctggtccccatgcgagtacaggttggatagcagctccaagaagatgaattccttggtctgagagtgggcaaagaggcaaggagggtgcaacctgatgcctgtgctgccctggctgccctgccgggccctgctaggactgtgcgctgggcttggagccccaagtacggcttttcaggcgcagcttctacaccacttaagactcgaagatctgcctccccaccgccttttctcactcagatggggacactgaggtccagaggaaaagtcacctgtccaaggttacagatctggaaggggacccaggacctatcatgccaccaggacacctgtctacttggtttttaaaaattttttggagataggatctcactctgtcgccaggctggagtacagtgggtgagatcactgcttattgcagcctcaacctcctgggctcaaagtgatcctccaacatcagcctgttgagtagctaggactacaggcatgtgccaccaccaagtccagcatttttaaaatttttatgtacagaccaggtctcactatgttgcccaggctggtctcaaactcctgtgctcaagcgatcctcctgccttggcctcccaaagtgctgggattacagggatgggccactgtgcccagtcccatgttatatttctatgggacagctctggtcttgaccatgcctccctccctggacctggtcccatagggctggtcggcatctctcccaggccagcatggccacctccatccccagtgccacagtcgccccctgcccccatggggcagtgcatgaacattgttgatcatgaggtgcatgatggtcctgggcaggagaccaaccatgaggtcccacactgtcttgttgacaatggccgtataggagtctaccaggttctgggtggtctcctttaagatctatttgcttagaatagtgtttactagaggtgaggaagggggaggaggtagccaaaggttggctaacagattaacagatataagagtacatggctgaatgtggtggctcacacactagcgtaatcctagctctctgggaggctgagcggggaggatcacttgaggccaggagtgcacggccagcctgggtaacacaggaggtattatgtctacaaaaaatttaaaaattagctaggcatggtggtccatacctgtggtcccggctactaaaacccaaattgaaagacaaaataaatcaaccatgacttttcacattttgtgaatgtgaccaaaatgtgaccaaggactgactgaattacatagtattacatcagttacatttcctgattttgatcattgtattgtggttatataaaataatgttcttgttctggaagtaacactgaaatatttgggagtaaatgggcacatctccaacttaacttcaagtggagcagaaaaaaagttgtgtgtgtccatggaatactatgcagccataaaaaaggatgagttcatgtcctttgtatggacatggatgaagctagaaaccatcattctgagcaaactgtcacaaggacagaaaaccaaacaccgcatgttctcactcataggtgggaactgaacaatgagaacacttgggacacaggatggggaacatcgcacaccggggcctgtcatggggttgcaggagggatagcattaggagatagacctaatataaatgataagttaacaggtggagcacaccaacatggcacatgtatacatatgtaacaaacctgcacgttgtgcacatgtaccctagaacttaaagtataacaataattaaaaaaaaataaatcgttaaaataaagaataaatgtaatagactttcttgaatataaaaagttgtgtgtgtgtgtatatatatatatatatatataaagaatatatggcctggtgcagtggctcacacctataatcccagcactttgggaggctgatgcaggtggatcacctgaggtcgggagttcaagaccagcctgaccaacatggagaaaccctctctactaataatacaaaattagccaggcgtggtggtgcatgcctgtaatcccagctacttgggaggctgagacaggagaatcacctgaacctggaaggtggaggttgcagtgagccaagatcctgccattgcactccagcctgggccacaagagcgaaactctgtctcaaaaaagaaaaaaaaaattagctttgtgtggcggtgagcgtctgtaatcccagctactcaggaggctgaggcaggacaatcacttgaacttgggagatggaggttgcagtgagccaagattgtgccactgcactccagcctgggtgacagagtgagacttcatctccccccccgcaaaaaaataaagccattgaggcaaaatgtgaactggtaaacctgggtgttctttgtactattcttgcaacttctctgtaagtttgaaattatacaaaaattaagttacaaaacacattaaaaatgtctgctgtatttatctgcttgacagaaatagatatgtaagaatcactttaaggctagagctttcccacttgctggctgctttttttttggagacagggtcacacttcgtcgcctagattgtagtgcagtggcatgatctcggctcatcgcaacctccacctccaaggcttaggcagccctctgaccgcctaagcatgtgtagctggactacacatgcacatcaccatgcccagcttattttctacctttttagtagagaggaggtcttggtattgcccaggctggtctccaaccctcaggctcaagcaatccctcccacctcagtctcctgaagtactgggattacaggtgtgagccaccatgcctgcctgttctcctggacatgcagccagctaagcttggctctgcaacagctccttgtcccactggagaaaaagagcccacagctttcctcatatgcaagggcatgaaccaaccaagtgcagcccagctcctgtgagacacacacacacgtggttaactgacagcgacagagagcctaaataaagctcagagtccagggtagtctacccaggttgcagctggtgagctctgcctccggttaggctgaagcatcccagtatcaatcctcccatacacatttattcacatttgttgagatctcctatgttctaggcattgggctcaacattggacacaaagacaccattcatcctaactcccactgaaagaaagtcaacctctgatacacgataatcctgttgctaccttctgaacatgggcaagttggcccaaattgtatgtacccagcaggggctgaagacccagggaagcagggtggagctgccaaagcagctttccaggctcatactgcagaccactctcaacacgttcaggcttgcccttgctcctttactaaactctggtgaacccactccccataaaccagatgcagcagcacctgaatcccagacaagtgccagctgatctgttgcctcgagagctcctgcctttcctctacccacacacaactgcaaagatgacacaggcaaggctgttgtcccagatttattgaaaataatacagcactacagaaaaaattcaaacaggtccccgaggcgttttgaaattcatcccaactgtaggctgagtgacctgaaggttggacagactgccgaagtcctggaacgagaaaatggattcagtgagcagttactggtgagatctgtgagtggaccccagaagaaaacacaggcccctagagccacagcactctcaagggggtccagaggcgacctgaaggaccctttaagagccaacagggttctcaatgcctcccacttttccagagtgatcttccttcaacacacacctgaccatgtggtatccccatttacaactctatgacttttacccaatgtaccatgccatttgtatctgttttcacaaccccttcctatcaatcactctaaaacaccgtttctcaatcttggcaacgtagacatcctgggctggacattctttgttataggcagctgtactgtgtattgcagaaagtttagcaacatccttggcctctaccccttagaagttagcaggtatcccctggctatgagaacgaaaaatgtgtctggacattgccaaatgtcctctaaagcaaaactctgtccctttgagaatacacagtgccacttgctttccaggaccagccctgggtaagagctattactaatctaatcaacatttgtgaagggcccaagtacacaaggcatcaagcagaagggagggaggcaagagcagaccctgccctcaaacaagttcaggctggtaggcagggcaagaagccaagggcccaacttatacctggaactccatgtcctatttggtcctcagaaacccattttagtttcaacaaaaatgctgcattcagcgcagtggttatttcaggaagaaaagacccacagcggggctgtagctgtactggtgatgtttttctgaagctgggaaagtacatgtgagttcattttgctactacctttttgagtgtcttaaacatttaatgaccataaaaataggaaaaatgaagttgttcaaaatcaccaaccgcccatgaagcccatgctttcacccaagtatgcaaaaggactaagataagccatagaaaaaacatcaaagtgcaatgaagatactcgtgaactacctaagtagtgccttgtatgtacctggaaatggaccaaagctcatttctgagtggttagcatggagacaccaaaggaatgccttcacagaagaaaagcaggcagattcagccagggctgacacaaagggggcaacgtaagccagctataaaaccaagaacagaagcagccaagagagaaaaggtgtcctggaagccactagatttgggaatcatgatcttgtggcgaactaactcaatgcacacaacttccgctacaccccttatgaaagcagtccagtttagtggctacaagtttagatgggattcccaactctgccacttactagctgggtgaccttggataataagacctactgatggtttttgaccaggaaaataccactttaggaatccagcaaacacttaccaaaagcttcagcatttccttagtgtcaggatctacttcaataatctcctgatccaaggctgagacctacaaggaaacgaggtagggtcaaaataccaatcaatgagattatcactcacctctcctcctcctctccccaggttcttaaatatggggaagaggagctgcacaaggatagcattcctctcacaaggtgagcagtctcttacagtattacagaccccgatgacctgttcttctggccttaccttcccatgccctcattcagtattcagaacacttgaagtctgtgtttacaccaaagaatactatattaggggcaaacaatcgagccacgacagcagtcatcaaatcaacattaagggctctcatgaaatatggaatagacttaactggttccagaagagcagaatggaggctaagaaactggtagggggcctatgggcacccacagctggttatggaatgtatggattaaaggtctcagattcagctgaggtccctttggaagccaagaacccatagctttatcatttgaggattagccagaagcccaaatatccagaaagtttacctcaggaacataattgtctctcctttctctctcctcctcctgcagcttgatggagatacctcttactgggcctctctgaattcgcttcatcagatgcgtgacataactacaaagcacacacagccaaagagaacagtgagaagacaaatcaactcccacctggtactgagcacatgtgcatatataaatacccgctttagttcttttccacagtgagaaggaagaggactcactatcctgggacctcctacacatagaacctccactggcctgagcattccttccccttggtttctcactctctattcaaactctccttcatgatgatcaagcgccccacccccaactcgccccgccccgccccgcagtttcacgacccttcacagccttcattttcttccaatttcaaattcacataacttggcaattaatacgttgactttggcactattcttccaggccatatgcctataaatctctcgaacagtaactgcaactgtgaagtaagcattagaagttgacatccagccgggcgaggtggctcacgcctgtaatcccagcaatttgggaggccgaggcgggcggatcgcttgaggtcaggtgttcgagaccagcctggtcaacattgtgaaaccctgttgtctactaaaaatacaaaaattagccgagtgtggtagcacgtgcctctaatcccagctactgggaaggctgaggcatgacaatcgcttgaacccgggagacggaggttgcagtgagccgagatggcgccactgcactctagcctgggcgccagggcaagattccgtctcaaaaaaaaaagaaaaaaaagaaagaaaaaagttgacaactaaaagcaacgtagcttcaaagcaagaggtctgacggtggctaccttcgacccagggtcaccgcggccagtcatgacacaggcctaagttcacaacagaaatcctgcacacgcagagctctagcccttctccgggacaccagggagtctcaggctaacgaaaccaccaaggcaccgtctcttcccgagtcggagggcggcagagcacacaaacagatcgcggagccccggaggccgaggaaggcccgactcaccctgctatcttgttgcggagctttttgctggggataatggcgatctcctcgcacacgcgcttgttcgtgtggaagtcgttgcccaggcgcgtgtagtacttttctatgatgacccgggccgccttcttcacggttttggtgcgaacgcggccctgcgggtggagaggacaggatcactcacgagccagcgcaaccttctgggaagagtgcggcgccgagccccggccggtgtggttggggaccgccggctgcgctgagccggagagggcccggctaaacagtgccgggcgccgggcttaatgcggaagccgccggcccgttgcgctccagcctgacagggctctgcgccttcccggcccagggcctctctgtgggctgaggaccgcgggaagctgcagatgggggacgattgtggaggatggcggcctcgagccaaaacacctaccatgttggcgggtccttggtaaaagaggaaacaggaagcacaggcgaagcctgttaaagcttaggccagaaagccgcttccgcccggccacggtcgctctgagcctactcgggagccacacagcgccccctggcggagtggagcgggggcggcggtggcgcgcccctccggtgggcagggtgtctgtcccgcccccgacggctcctccctttccgctccccgctcccctcggttgacttgggctcgcttctctcccccatctgatttttaatgggaccgcccgtgcgatgtgctctagcgtagcgtccatctcttccacacacgccagggagaggagaagcatccggtcctcgggaggaccgagaaaagaaggcgatccagggccgtggaacaatgaggaagtgggggatggcggccgcccaggtcccccactcagtccgcgggccggagacttgtcaggtagagacagggtgcgactgggcgagacgtatctcatttcttccgggcctttgctcaaatgtcgccttatcagagggctttcccttcaaacttaggtaaaataactccctcactatccctgcttatatttcctagcacttgccgtgtgattcggcttatttttctcaactaggggtgagctccatgacagtaatggtcattttgtttagctaattcccagtgcttgaacagcgcctagcacgtaacaacctctaacattgacgtgaagggcccagctcaccagcagagctcccaacacctcaggtaccttctccatccactatcttcaggctgttcctgccgcacccatcctcaaaccagggccttccgaagccaccagcgcaggctgccccgatgggccgcagcctaggtagggccctgcccccttcttccaactctgctccctgggctgacagcaatcctaggctcccacctgacaggggaaggctgagctggccaggctggatgagttaagcccagggctgtgcctcattcctcaacgcaccttgggtactccagtcggactctcaactgattggggatggaaacctgaaggacaggaaaccctggcagcaaaaagtaccaatgggacaaaagaaaaggccagaatctcagaactgcgggagcaaacttccagtcaagctgctgtcaggcccgaagtgaaagatcagggtttttgtttttgtttttgtttttgagacggagtcttgctgtcgcccaggctggagtgcagtggcgcgatctcggctcactgcaacctctgcctcccaagttcaagcgattctcctgcctcagcctcccaagtagctgggattacaggcgtgcgccaccacgccctgctaatttttatatatatttttttttagtagagatggggttttgccattttggccaggctggtctccaacttctgacctcaggtgatccacccgccttgtcctcccaaagtgctgggattacaggagtgagccattgcacccggccagccttttttttttgagatagagtcttgctcagttgtccaggcttcagtgaagtgacatggtaacagctcactgcagcctcgatttcctgggctcacatgatcctgctgcctcagtctccctagtagctggaaccacaggcacacaccaccatgcctttttttttttttggtagaaatggggtctcccatgttgctcaggctggtctcaaacccctggggctcaagcaatcctcttgcctcagcctcccacagtgctgattgtaagcgtgagccactgtgcccagtctggcctctcctttatttatttatttatttagagacagtctcactctgttgcccaggctggagtgcagtggcatggtcttggctcaccgcaacctccacctcccgggttcaagagattctcctgcctgagcctcttgggtagctgggattagaggtgcctgcaactaccacctggctaattttttgtattttcagtagagaaggggtttcactatgttggccaggctggtctcaaaatcctgacctcgtgatccgcccaccttggcctcccaatgtgctgggattacaggcgtgagccaccgcgcccggccaggcctctccttttgtgaggagactcccccaccttgcccaatagttcttgcacctctctcagaagagacagcttcagtatgcagggttccctccacctcagactaaattggaggttcccaaagaatcggtccaacagctgggcccaggccaactcgactgaaaaaaaaaaaaaaaaatcagcagaccttgccagaaatcctgtgagctctgagaaagttccgttgatagggctctctgaacagcaaaaacccaatcgctccctctcagaaaggaactgcatcatcataggtgggtccaagaggatgagcagcctccgaagaagtaataggccaagacttccaggagaagctgagaacaagtggcttctgctggcacgtgagcagctgtgcctccagcattctctaagctgggcctggaggctgtgaggacccccgagaagctaagatatgaggactttttatatttgggctagaagcacccatccactggagaagcatctccaaagtatatttgacgatggaagggaccaagaagtactcacagggcaggtctcccacatggtcccaccattatcctgggccaggatctccatcacagaaatccaaggaaacaagctgtggctgtgccattacccccttactccctcccgttagccccttgctcccagacctcaaacacagagacaaaaccagaactctgctgcaacgtgtttattatgtgccaaaaaaactacaccacagcttactccacacatctgtaggagagtgcagtcttgcctgcatatactacaatgaggtagagacttcacacacagcttcacaaaacccacagagtagctgggatatgcaacaatgcaacgtcagctcagcaggagggaggggttatgacactggttctttggcacacagcttccctaggaggggcaagtagtttttgtgggttttttgtttcttttttaaaaaaaaaaaaaaaaaaaaaaggaaagaaaaaaaagtcaagttttcaaattccagtggcatttcagtcaactgcaactgttatctcatacattcctcaaattaaagatataagggaagggtacttgccccctctaagagaaagggctcctgtgagccttcatctgcccccaccgaaaagcagccctttttagctcagttacaaaagaaaaaagtcctgtgactttgtgattaaaaacttctatcaaccccacccccccacataagtgcaacttaaggaggtgcaataaaccatttaaaactatatacagcagccgctcaaacaccgtttatccggtccagtttcaaataaaacaaaaaattttttttttcttggttgcaaatgccttgatttgcaactgtgagaaacagtgaccagcagtcccccagacacaaatttgctataatgttaaaagctgccaggaaagaaaaaatatcttgttccaaacgacttaaaaactgttttaaggagtgtaaaaaggaaccggtaaaaaccctcgagcgtaaaatatgaaatatgattttggtttaaatgaagagcaaagtctccttattgtttacagtaaaaaacaccagctgaacactcagtttatgccgttcaggtgggggttaaataaatggaaaggcactgtatggcaactgcaagaatgaaaccaatgagacctgcgcatcatcaccatcagtattgcaaggaatgtaaaaaagcgcttttaataaataaacctaggtgtaggcatccgtgtcaatacctcaataccttctggacacgtagttttttttttttttttttttttccccgcttttcatctgcaaaatgaggaactaaaatctgggaaaactacagagtcgcttggagggtaagccagagggtccttgcccttggtacaccccctgaaaacaaaacctgacaaaactcaatgtgcattaattagtgcagaaacaaagacagattcagcaagtgcaaaggtgactacaattttcccttgtccttgggaagccagctccctggtcgccagtggcagggtggtgcaggctgcttgcctgacctgccagctttgggcgccacaggccactgggcaaggccagctcctctagctggaatctcggttcttctggttccgcatcagggggctgtggtggcgcaggccctccatgctgtgccgccagtgccagcagctccggcagaagtatttgaagcagacctgggttgggggaacaaaaaggaggatgccatgcctgtgtcagcaccagacacaggagctgttgcacgagctgcttgttctgtttggagaagggtgggagactcccgatggcctctgtgggttagaagaaatggtccctaggaatgctctcaccccaacacagaagcctgattaactatggcaaacccaccatccttgttacaggtccccttacttaaacatgttgggctcgtagtgtgtgcagagaccatgctagtttctcttatcccctctaaccatgacagctgctctcctattcccctgcccttctcacctcctacagagtagttgtatcacatggctgctaacgtggagaatgtataaggatactgactaaaaattctaatgctaggcaacatcctgctttcttcccattaagtgaggagaggtgactgggtttctcagtctagtcccatctcttggttgctgtgtaacgtcaggcaagccactaatctctgagcaattatctgactatggagattatctgtgaaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccagaagcagaagagaaagaaacaggagaaatatttgaaacaataatgactgagaatttctctcaatgtgagacaccaaaccacagatccaggaagctcagaaaacatcaagcaggataaatgcccacagaaaaactgcatctagccacctaagttacaaactatgaaaaaaaaaaaatcaaaagatgaagagaaaattctggaggaacctagagggaaaagaaaacacaccttacctacagagaagtcaagataagaattacatccaacttctcagaaattgtataagcaagagactggagtgaaatatttaaagtgttgagagagggggaaaaaaaccccaccaccaacctagaattctatattctgtgaaattactcttcataagtgaaggagaaataaacactttctcatacaaaaattgagggaattagttgccagtaaacatgccttgaaagaaatgttaaagaaaagttccttgggaaaaaggaaaatgatacatgtcagtaacttggatgtatatcaagaaaggaagagcactggaataagttaatataaaatgaaaattttattcttcttattcttaatttatctaatagatcaattcagatcaaactgatcaatagatcaaacatcatttgttcaaaataataattagcaataatatatttgattatgtatatattttttgtatataaatgatgtgtatgtttgtatataagtgaaatgaatgataatgatacaagggacaggagggaagaattaggacaattttgttattataagatactcacactacctgtgaagcagtagagtgttatttaaaagtgcacttaaactagttgtaaacgtattgcaaatcctagggaaaacagtacaaaaagaagtataactgatggatatgctaagaagggaaagaaaatggaatcatgaaatgctcaattaaagccacaaaagatggaaacagagtggaagtcaaaaatagaaacaaaaacaaggacaacaaatagaacacagtaacaaatatggtagatattaatcttactatattgatataataatcactttgaatgtcaatggtcaatcaccaattaaaagagagaaattgtcagagtggatcaaaaacaaaacccaactatacactatatgttgcctacaataaactcactttaaatataaagatacatatagattaaaagtaaataaatagaggaaaaacataccatgctaacactaatcaaaagaaagcaggaatagctatatgaatttcagacagagcagcttcaaagcaaggaaatttagcaaggataaagaagggcattacagaatgacaatgggaatccattctccaagaagacataacaatcattaatgtgtatgtgctaacaacagagaatcaaacaccctgaggtaaaaactgatagaagtgtaggaaacatagatggatccactatcatagcaggagacttcaacacgtctctatcagaaatggacagattcagcaggcagaacatcaacaaggacttaacaaggccattaattaactggatataattgatgtctatagacaacttcatcccacaatagcagattacaattcttctcaagcttacatggaacattcatcaagatagaccacattctgggccataaaacacactttaacacatttaaaatcatagaaatcatacaatgtctgcttttatgccacagtggaattaaattataaatcaataacagaaaggtaacaggaaaatcccaaaatatgtggaaattaaacaactttctttctttctttccttccttccttcatcccttctttccttccttccccttacccttccttccttccttccttcttccatccttccttctctctctctctttctctctctctttctttctctctctttcttgtgggatacagtaaaaacagtgctatggggaaatgtaaggcattgaatacatatattagaaaagaagacagatcttaaatcaggattctaagtttacacctgaagaaaatagaaaagaagggcaaattaaatccaaagtaggtcaggtgctgtggctcacacttgtaatcccagcactttgggaggccgaggtaggtggatcacgtgaggtcaggagttcaagagaagcctggccaacatggggaaacccagtctctactaaaaatacaaaaattagttgggcgtggtggctcgcacctgtaatcccagctacttgggaggctgaggcagaattgcttgaacccagcagccagaggttgcagtgagccaagatcgcgccattgcattccagcctgggtgacaagaatgaaactctctctcaaaacaaaaacaaaaacaaacaaacaaacaaaaacaaaaacaagtcttggagttgtagcttccgtgaactgtgatccttgagaaagttaggaaatcccccactgggagtgaacctaggaagtagttcttccctatctctgttattttcatctccttgacctgggctcccctccttatgttttctggcctggattctcagatgaggaaactgaaactcacaaatatgcagtgactcagattatacaactattaaacggcccacttgggcctgccctgggtcttgttactttcaaagcccacgctcttgacagtgcattattttgtccatccattgtctcccattttacaaaacacatgcctgggccaagattaaacttcttgttgcccattcttacttttggcttttccccacttctctgagggtttaccacacagtgcccctaccaccaagaggccctccttgtcttcactgttgaattaacatatgttaagggacatctcaaatgcatcctccttgatgaaacttttcttcattccaacgcattcataaggtgccatcccttccccttgcttggaccttgtcagcactgtgccagagtgggggtcttgggtctaccacacccatttttctgctttgttttctgtttttttgtgggggtcagagtctcgctctgtcatccaggctggagtacagtggcacagtctctgctcactgcaacctccacctcctaggctcaagtgatcctcccacttcagcctccagagtagctgaaactacaggcatacaccaccacgcctggctaatttttgtattttttgtagagatgggatttcaccgtgttgcccaggctggtctggaactcctgagctcaagcaatctgccctcctcggtcttccaaagtgctgcgattacaggtgtgagccactgcgtccggccatttctccatttgaaggcaaggatggtgtcttatccactgtcctggactttggagcacctagtgccccctcacagttagtagccaagggtcacataccaaatgccatggactaggcaggtaacataaatgagcaaacgaggtgggtagggagacagatttttcctgaaacatggggcttcttggcccatctcttgttttcccacttttgttagagactcagttctttactgagtgaaaggaaacacaagcatgatgggaaagggagcctacttgcagccacagtgctgggaatgaatagggagtggtggggactgaggaccggggagcataggcccttcctaaagggaactcactgctccaccccagccacttctgccagggagcaatttaagcctgacatggatggatgataagacttttcaagaaaagctgaaaattgagatttttgtacaagatcatgtgattcctaaacattggcaattgactaaaacatttttcaatatttgtgtcagccaaaacaaaccaaaaaatcaataactgatcaacacaagcaaatctgcacgctgtggttgaggagttgtagtcccatatgtccttattaggatgtcagagcaagaagtcaccttaaatcatccagtccggtggtttctgaatgccagcctctgaactggctagatcagaatccctgggaaggtctagaaaaacacagaaaatacacattctagggcccccagagccctggatctgtggaactagaatctctgggctgggtcctgggcatctgcagtttttcagagctctccacgtactgctgatgaccagccaggttcactcccagtgggggatttcctaactttcctgaggatcacagctcccggaggttcttggtaaaaacagcttcctagtccctagtcctagtttcctggaaatgctggtatagtgagtctgggatggggcctgggaatttgtttttaagaaactcatctgtgagatctggaaaatccttgcactagtggcccgttgaggctcagtgatgaggaagacttgctcagagccacatagcacgttgccccagcccatccaacctcctgactctcagagaaagctctttgaggccggcactgctggggcagttgtgagcagtgggagatgctctcagcaggggcacagcactgacgtgtgcagggcactctacatgcagtttggcaggggacagactggagggcgggtttggtttccgcagcctgctgggatggagctttgggctgggcagcagcagaaggaatcctggtgggatgtcagcagggcactcaggcattcatgtgagcccgtggagtctattgtcgtgaacagccaggatcctgggagctgggtataaacccaatcgagaaactccagattgccaagttccctaactgtgctctttagagcctgggaactgcagagagggaaaagagtgggaaaagcatggatgccagggctcccccacccccggcacatgagatttcttttgagactagacctggtggccaaagagatttgagaaacgtgatctaattcaactctttcacattaacgatggggaaactgaggcccagtaagggatggactgttgagaatataaagcaatgttactgaagagactgaaaccatttgggggacttgagtcccagtctcagcactgccactctcactgtcactgtgtggctctaggccaatctctccacctctctgagcctccctttgctctctcacctaggaagcagtctggacaccctactgcaggtgtcctaacctggggtccacagcctaagggaccgtgaactgaggggatccatgagcttgaatgggaaaatattacatatttactttttgtaacctctcaatgaaatttagtatttccctcaattatgaatattattagcaaatcccaacagcacctgtgattttgttaccaatagaacaaaccaaatatttttctatctcattacagttgttgcatgtatcttgaaataaggtttacgttcatcactacttcaaaatttccgtagttgctgggcatagtggctcacgcctataatcccagcacttttggaggctgaggtgagtggatcacttgaggccaggagttcaagaccagcctttccaacatggcaaaaccccatctctactaaaaatacaaaaacttgctgggtgtggtggtacgtgcctgtaatcccagctactcgcgaggctaagggacaagaattgcttgaacctgggaggcaggggttgcggtgagccaagattgagctactgtactccagcctgggtgacagagagagactctgtctcaaaaaaaaaaaaaaaaaaaaccatagttgtttaatttgccagaaaatcttgtttaaagtataattccacaccctactttttaaattattttttgttttgttatgttttgtttttgagataatgtctcactctatcacctaggctggagtgcagtggcatcatcatggctcactgcagcctcgacctcctgggctcaagagagcctcccatctcaacattccaagtagttgggactacaggtgtgcaccatcatgcctggctaattttgtatgtgtgtgtgtgtgtgtgtgtgtgtgtctgtgtagcgacaaggtcccattatgttgcccagttggtcttgaactcctaggctcaagtgatcctccccccttgttctcccaaagttctgggattacaagtatgaacaaccttgcctggtcttaaattattttgataactgtatttcaatataatcaatttccttggtactcctgtgcatttattttatttattttatttattttttatggcagggtctccctctgtcacccaggctggagtgcagtgatgcgatctcggctcactacaacctccacctcccaggttcaagcgattctcctgcctcggtctcctgagtagctgggattacaggcatgtgccaccacgcctggctaatttttgtgtttttagtagagacagggtttcaccatgttggccaagctggtctcaaactcctgacctcaagtgatttgcctgcctcggcctcccaaagtgctaagattacaggcgtgagccaccgggcccaaccactcctatgtattttattttctgcatttcaaaatattgttctgagaaggagtttgtggcaaaaaaggataagaatccaggccttattgggaaatcctagaggacagagcaacagagaggggtttttaaactgcaagggcctgagcagaggtctgccaattttttccatccctggaacctttctttaaatgaattcttccatgtaaaagaaagaaaccagagccactctgttgaagtggcagttaggggccaggcagccccactggggtggtctttctctgtctccccattccaggaggcctggagacacttgcagaatgctcacgcacctgagagcacatttttaaatccatcaggctaataataatcataacaatcataattgccatcatattcaaccagtggttcaggcactgctaaatgtggagtagctcacctggtttaatcctcacagcagcatcaagagtgtaagtgctgtggttatccacattctacagagtcattcaacaaataccaaaaaaggactaagttctggacacttcctctgacacttaaatcttcaacaaagaatataaagggccaagtgtcgtggctcacacatgtaatcccagcactttaggaggctgaggtgggaggattgcttgaggccaggagttcaagaccagcctgggcaacatagcaagactcccatctccacacacacacaaaaaaattatccaggaccagctgcagtggctcacacctgtaatcccagcactttgggaggccgaggtagaaggatcacttgagcccaggagtttgtttgagaccagcctgggcaacatagtgagaccccatctctattttaaaaaaactaaaaataaaaacatattagccaagtgtggtggcacccacctgtagtcccagtccctccctacttgggaggctgagatgggaggatggcttgagctcaggagttggaggctgcagagacctatgattgcacacctgcactcctgtctgggcgacagaccaagaccctgtttccaaaaaagctgggggcaaagaatataaagatttttgccttcctagactacattgggaggggagggagaaaacaaataaatagaaaaaataatgaaaatgctaagtgatatggtatgtcagaagtgctatggggaaaaataaagcaaggaagagggatacggagagccagggagttgcaattttaaaataaagtcattataggaggcctcattgagaaggagacatttgagcaagaactcaaaagtgagtggtttagccacgtggaaaacagagggaagagtgttgcaggtgtagggaacagcaatgcaaaatcctgaagcagcagcatgtctggcctgtggaggaactgcaaggaggccagtgggcggagtggagggaactaagaaggtgtagctggaaatgagattggacaggtcaccttgcctagcgtctcatacaggccagaactttgtcttttgctcgagtgagatgggcaccattgcaggattttgagcagagaaggaccatgatcaggctggttttgaatgactctggctgctatattgaaaacatgaggggaggggcacctggggtaggcaatagtggaaacagagagacctgttaagaagttaccgcagcaatccaggccgggcagcagtggctcacgcctgtaattccagcactttgggaggctgaggccagcatatcccctgagctcaggaatctgagaccagcctggctaacatggtgaaatcctgtgtccactaaaaatacaaaaattagctgggcgtggtggtgcgtgcttctagtcccagctactcctgaggtgggagaatcgctcaaacccaggaggcggaggttccagtgggccgagatcgcgccacgcactctagcctgggcgacagagcgagactatctcaaaacaaccaaccaaaaacccaaaatacaaacaacaacaacaaaaggagttactgcaacaatccagatggagaaactgaggcacggaaagatgaaatagcagagttagtagatagcccagcgaggatttgaatccagatactctgactccagcagccccctcttggccgctcccctctggtccctggccaccagcaaggaccccggtctgccctgggcctaaggcctttgtggttccctccctgcaggaagtgtaaccgagggccgggcggcaccggatatcgtgcaccaggttcgcgtggacgctggggggtccttcctgtcctgtgagctgcggccccgcgcactgcgcaagcgggatgtatctgtgcgccgagacgcgcccgccttctacccgctgcaataccgcaggcgcgagctgcgcttcaacctgaccgccaatcagcacctgctggcgcccggctttgtgagcgagatgccgcggcgcggcgccctgggtcgcgcgcacatccgggcccacacccccgcctgccacctgcttggcgaggtgcaggactccgagctcgagggtggcctggcggccatcagcgcctgcgacggcctggtgagtgagctgggacatgtatacttggggcagtctcgggtggtgggatgtggagattggctctagccttgccacgcacttgtctggtggctttgcccagtgcactttttctctgccagcctcggtattcacgcctgtaaagtgggagtgacaacgcaggcctcgttcatctctaggacaacagttctcaaagtttaatgtgaaagccgggtggtggtgcacctgtagtcccagctatttgggaggctgaggcgaaaggatcacttgagcccaggagttaaaggatgtaggacgtagggtgtgatcatggcgcttagctggagacacagcgagaccccaggcactaaaaaaaaaaaaaaaaaagaaagaaagaaagagaaaagaaaagaaaagtttaatatgagctcaaatcacctgcaggccctgtttaaacagaatttttgcagggtaggtctggaatggcgcccaaacacttggatttctgaaaacgtctcaggtaatattgaagatgcaggtccagagatcccattttgagaacctctgtttgactggactaagtaactgaaaaagcagttgacttctcttccttggggcatcagttatgactgttccttcacaggtccctttaggctgcttttctccaggaaagccacccctcaccctgtagccattctgcagggtgtggtgaggaacccctttcagcccctctgctcggatcagagctccgggaaaagcaggcctcagcttcctggtttcgactggctgaagggtggtgctggctactgcagccctaattgctccctgattgggtgctgattagagcagcttccactccaggcagagtagggcccctttctgttcgtgttcaggtgaccagccccactctcccagctctggagggtgggggtttgggaggagtaggggatgtgtgcacactctcagcgtccactgttcccaggaggccctcagcttagattgctcaggcaaaaaccatgggctgtggccgcacagggcctaatgacagggcagcccacaacgcaagctgcacaacgtctggacctttgaaggcccatctgccctgcacagtattcccatttatggagcctgtgcctgtcccttaatgtacaattgatcttgttgagcctgtgccacagctgtgcacatggggcatcattcccatttcacagatgaggaaacaggctcagaggggaacttgcccaggctcacctagtcattcagtgagtggtgggcgggagggggggacttcgcattcatacccaggtctccagacccaagagctgatgcactctccagccctccctccaggccccctggtcctgtgtgactcaaggggcagaattggtgcctatgaggggaagtccgagggatgtaaaaccttctttcctgttggagccctgagcttcctcaggaggtagtgggcatcatagatgcttcctggggcccctcccctccctggactctgaatgttggcggacatgtccaagacactcctgccagcttcccttctctgggcagccctgggcccagagaacagggtgtcctggtggccgtgggcatctccgccactcgggtgtgggtgtggatgcttttggagtgattcattgccttagggagatagagggaaggtcagaagccctggccagctgggagggagcacagtgctggaaatggctggcctgcagagaagacgcagaatagcctggaggcctgggcacaagctgccctgctcaggacagctgtctgggactttggaagacaccattttgtcagatttgggtgcagacccgttttcctctcctaatagggtgggtgtgtggggcagcatccccaggggcggaggcttctgagctccgctttgaaggtttggctgtgtgtgaaatggcagagaagggctttccagatggaggctacagagtgagcaaaggcccagcaggcggaaagtgcagggtgtctgtgggcagtcacagatgatgtgggcagtgggggctcagctgagcaggatgggcctctgggacgtgcaggaagagcagctgagggccagccctccctgtgtgaccctggtgcttcttccctagaaaggtgtgttcctgctctccaacaaggactacttcattcagcccctggacggtgccccagcctggcccagccatgcccagccccatgtggtgtacaagcatccggccccggagaggctggcacagcggggtgattccagtgctccaagtacctgtggggtgcaaggtatgctcttctactcccagttctcaggcaggtgctaggcctggggacatgaaggggcctttctagaagcccctcgtaacatgcccatgctcggtgtcccttagaccagaggatacagacagacagacggatacatcactatagcgtgtgcccttaattgtgccacaagactgtgtcctctgcctttcaggcctgtcccagtcagtcccctagactgacctccctctctccatctcacctacttctcccaccttggggctcaacctccctcttgctccctccccaccaagcctatggcacctggctctgccagccattctccctccagtgtccagaccaggtgagccatgcccagctccaacagggccattagccaggaacctccctccccatgccaccctgctcccaccctagaataactaacctctattattgggacctggagtgtggtacccagtgcctcctctgcagagcagcagtagtgccggccagtccaggtgaagagctgcctgctaagggttgctgggatttggggaatgcttggctggcatgccaatctcaggctgcccacagctctggtactccatttgctggagcacatatccacagaggcatgcttcttggcctcattttccccagcttcatagatgtgcttcctcttctgatctggagcagcctgggtcaggggagcaggctcagtagggcaagctgggctgggtcttggccagcctccccaggctggggtttagagggtggggtcaggggtcagtgttgagatgcactaagcccccagggtgggaggaagtgacacggggagataggggcccagtagccagctttgtcaagcccaggagttcccctcccatggacacagtactttactgcgtttatatccaccatttcatttaccctttgaggtccccccatgaggcagatcaacttattcctatttttagtcagggaatctcaagatcaaagaaagaaagtggtcaggcagagccacacagcacaggtttggggcagagccaggaggggaattcaggcccctcgcctctgatccctgtgtggttcccagtgccccagagaactcgctgaggagaagccctggagacgtgtgccctgggccaggatgggccagaaggatggggaacagatgttccctcaggatcagatgtttatttaagactgacttgttgagagccatcgctctacctgggataaggtgatggatgtggaagagcatgattctgcatgtggggactctgtctcattgtagcatttcccaaggaatatttcagggagtgtgttccaaagaatgccagtagtgcactgtgaaaaaaaaagatgctgctgttgaataagtttggccacacagggttaaaaaaagtaaaacgggccaggcatggtggtgcacacctgtagtcccagctacttgaggggctgaggtgggaggattgcttgagcccaggaggtcgaggctgcagcggctgcagtgagctgagatcatgcaactgcactccatatggatgacaaagtgagacactgtctcgaaaaaaaaaaaaaaaaaaaaaggtaaaacagacttcgttactacaggacttctcagagccctcaaagtaaatattcattgagaatccccaacagaataggcaggcagcattccccaaatttaggaaataagcaggggctttgaagcagtgaaacctgggttctgagcccagcttcaccctctctttgagcttcagttacttcatttgtaaaatgaggataattgtgcctacctcagaagtaagattaaatgagataatgcatgctaagcccccagcacagggactgtacatgttaggctcgatcaaggttggctgtggctatttttttggctgctgcagtatctgacccacagccaccttcaggacagcctcatctttctttaccaacgccacctacagaccccaatttatccgtgttctccctgtgctagactcagatctgagtcctagagcttgggtgggtttgtcccaaggatagcaagacaggtcccttttcaccctattttctttttttttttttttttttttgagatggagtctcactctgtcccccaggtcggagtgcagtggcgtgatctcagctcactgcaacctccgccttctggttcaagcgattttcctgcctcagcctcctgagcagctgggactacaggcgcatgccaccacactcagctaatttttttgtatttttagtagagatgggatttctccatgttaaccaggctggtctcgagctcctgacctcgtgatttgcccacctcagcctcccaaagtgccgagattacaggtatgagccaccgtgctcagccagtttcaccccattttcacccccaattctgttcttactctctgaggccacaagcccttttcgaggggctcttgtcacactttcagctcaccaggagcctgtggttatctgtaacctccagatcttaccttcacaaacactgcacacctctggcatgctctccagacctgcagcagaacagggctgggcttccctggatatcatttatccagttgaaacaccccacattgaccttgggccattaaccaatgttacttggttgagttgatcagccaattaagaccctgcctccctccaacatctcccaatgcctgtattacccccatagctcctgggagacagtgaggttatatatgctgagggaaggcctttgtggtggcactaagctgcccctagccctgactcagaatatagcttgggtcagtcctcaggcaggcagagcagaccctcaggggcttctggtcctctggagccactttgctggggactgataccaagcttacctgtctgtggtctaggaaagatttgtggtctgggaaggggcgtcggaggcctcttgtcctctgtaggttctgctgctgccacattggggcagtgcgtgtgaggtgtggggacactcatgcattggtgcatgtgcattgcctatccgctgtgcagcctgtgtgcacccgtgtgagcgtccctgtgtgtgagcacaggtgtgcattgccctgggtgggtgggtggcttggggtgggcattggctgcttgtatccttcatcctggtgacagcctgaccccctcatctcttgggcaggtggctggcctgtttcacgaccccagcattgggaaccccatccacatgaccattgtgctcctggtccttctggaagatgaggaggtgagcggtcatgtggtcccacgctgcctggcaatggcttcggctgccagagccctcctgccccatgacctgtgctgctctgtatggaagggcacagtgaaggcctccttggactggactgtgtcccctgccactccctggttcctgactgaccctctctcaggtcccaggtctcctgcaggaggttcctacaggagggatggtcaggccggaagctggactggtgcctgcgggcctcccactgccctgctgggcctctgtctcctgcctttgtatgggggagaattgggcctgaccttcttggaactcaggggaggcatgagcagtcactctctctgcccccaggaggacctaaagatcatgcaccatgcagacaacaccctgaagagcttctgcaagtggcagaaaagcatcaacatgaagggagacgcccaccccctgcagcatgacactgccatcctgctcatcaggtactgcagctgcaggagggtgggagcctgcatctcagggaggtgcttcccagccctagggaagaagccctggtggaggagggggccgtgctgtcagggagccccattttgaggagagtttgcgcacctttggcccaaggctggattctgtccgcacttagggaggtctttttattttgaaataattgtggattctcacactcttgtcaaaaataatagagagagggcctgtatagccttcatccatttcccccggtggtaacatcttgcatgactacagcacagtatcccaatcaggaaactgacactgataccatccacagacttactcaggtctcatcggttccacatgtacttccctgtgtgtgtgtgtgtgtgtgtgtgtgtgtgtgtgtattcagttctgtgcagtttcatcactgtgggttcacctacccacccccacagtctagatacagatctgtcccatcagaaggatgtctcgtgctacccgtttatagtcacagccaccttcctccctcctcccctaacctccggcaactgctgatctgtccagaggcagttattttccctctgctggactctggcagcttctgtcagtgcccctgctggatagtaaccaaaattattctgtgcaggtctgtgttcctgagggccaaagagatgcccagtggcttgtgtgtgaatgagaatacctccttcccaagtggccactgtgctggcctcatgtcacagaatggtgggaaggacatccttttcacttgggatcaactgggggtgacccttccctggccttaactcaggtgggcctggcactcgctaggttagcctgaaggccgcttctctgcctgtgcaggaaggacctgtgtgcagccatgaactggccctgtgagaccctgggcttgtcccatgtggtgggcatgtgccagctgcaccgtagctgcaacatcaaggaggacatgggcctgccgctgaccttcactgtgatggcccctgcaagctcactggcctcaagaacagtcttgagcacaggtaccgtgcctgcccctattgctacactgagagtcgagattcaccctcccagcctgagagcactgggtatccagcctgtgggtcacaaagtccaggggaaaggaagctctctggagaagaagccccgactgtctggccatgtgctgcccctgcactgtgccctccccacaaccaggcttccctgttaaacaggagagagtcctgcctgggcatctctgggactggcctggagggagtcttatttaaaggggagttgtgatgggctggaaagtcattgtaggtctttggctgtccctccccattgccctcagtgctgtattttttactctcgatccctgtccctgttcctgtttgctctgtggcctgggccagtgcctgccctctctgggcctctgtgtgcttcccatagattgaggggtttggattcagtgatgtccaaggctccctctatctgacaccgctgcctaaggctcctgtcttcacaggcctccagccacctgtgccctggctgttgagctggcgaatatggcagcatcttagattgtctagaaagccatcaaaggcaggctcccagagggttctgtgggtcaaagctgttggggtcatccattcagatgtccgggttttgtgggtgatggccgtgcctgcaggaccttgaagctgcttatggctgcagaaagaacagcctgccgcagtactacaatttcctggctgtgttaccctggctagttccttagactctctgagccttcctgagggtaataatgagaactgagtgagactgtgtttctgaaagtgcttagcatggccccggcacatagtagatgctcaggaaataatttttctcatgtccttcccaaggatggtctctggagacctttctgtgatacagcagctcagatgccttaactcaagtgcacagccttgggacaaggacctgtgagtgggaaccgctgtcagactgttcttgaggccagtgagcttgcaggggccatcacgggcccacatctgtgccacctgatttgccattgctggccagtccccgggctggagcagggctgctctgggtccctggccctcatttcaggctcaggccggagtaggagcccttgggatactagctgtcataccctcattttacattaaagaaactgaggctcagcgagagaatgtgactttctcaaggctgtggccattgagtggcacaaccagccctgggaactaggactatgcaccttgtggttctccagggtagggcaggctagaagcctcccgccggcttacccgcccttggggcctgtgctctcacacagttttggcattcagcatgatggaagcagcaatgactgtgaacccattggaaacagcctttcatcatgtttccacagctcccgtacgacgccgctcccctcacctggtcctgctgcagctgccagtacatcaccaggttccttgagtaagtccctcccccagccctgagcccctacgccttgatccatgagatcaaggtctaatgggggagatgcagacagtcacactgcagggtcggggtagagggaagcagaggggcaaggtctcgatccatgaggtcaaggtctactaggaaagatgcagacagtcatactgcagggccgtggtagagggaagcagaagggcaaggtcttgatctgtgaggtcaaggtctaatgggggagatgcagacagtcatactgcagggccagggtagaaggaagcagaggggcatctggcaaaaatgtgctggcatcccaaatgtcctcctggaagggacacttgagcttgaacttggagaaggagtgagaattcacacatgtgcagaagggagaagaatggcgttcctggtagaggaagcctgagaaaggcctgcagcggtaaaggagtgggagagctttcagggaacggcagaaccgtaaaggagtgggagagctttcagggaacggcagaaccctgagcgaggctatgggagccaaggctgcgtaggaaataaggctggaggaggcgagggccagccacagtgtccagtgagaggcaggaagaaggggccactaagggaactgaaatacaaagctttctcctttttttcatgttctcttcacttgttctgatgttcttgttgttgttgtttgtttgttttttgagacagagtctcactctattgcccaggctggagtgccatggtgcaatctcggctcactgcaacctctgcctcccaggttcaagcgattctcctgcctcagactcctgagtagctggaactacaggcatgtgccacaatgcctggttaatttttatatttttagtagagacggggttttgtcatgttggccagactggtcttgaactcctgacctcaggtgatctgcccacctcggcctcccagagtgctggaattacaggcgtgagccaccatgcccagcctgttctgctggttttgttttgctttgttttgctttttaatttgctatttaatgttgttctaagtaagaaaaagttttacatttaaattattagcataaattttaccattcatctttattttgtgcagtgccagttttaaatgcaaatgtaagagtacagttgacccagaacaacttgggggtcaggggtgctgacctctgtgcaactgaaaatccatgtataactttgactcgcccaaaactactaatagcctactgttgactggaagccttactgataacataaacagttaatacatattttgtatgttatatataatatatactatattcttacaataaagtaagctagagaaaagcaaatgttattgaaatcataaggaagaggaaatacgttcactgttaattaagtggaagtggatcatcataaagatctccatcctcatcctcttcatgttgagtacgctgaggagggaggagaaaggcagggggtgatcttcttgtcttggggtggcagaggtggaaaaaaatccacacataagtggaccccgttgttcaaaagtcagctgtattaacttgtatgcagggtaaccaaaattacacaattcgtcttttgtagctgatatttactagatgatgagatagaataaaactatctcaattggtttgatctcactccttgatatgtgcacattctacccaggctctctaccttttcttaccgatgaagatggaaagactgaaaggagaaggaactatggggttctctttcctcccatgtcttcattttctgcatagcagttggctaatacaggggtgttaacatgggagagaaaggatgatggggcttcttggtcattgtcttctttctgcatttgaagtaatggttcaaatggaaaatgcagcctctgggcctgtcagtgccccctgtcccttactcagttgttgacataacatgtttatcttctaattgctttgagtctcaccgaactcctacacattatagattctgacatggaccaaagtaaatgttagatgcaagtggggcagcaaggaatggtggacacagacactgcctgtgtctcctctgttcaaacacaggcttctttgtcccatcagaccttgcttactggccaggcgcagtggctcacgcctgtaatcccagcactttgtgaggccgaggtgggtggatcacctgaggtcaggagttttagaccagcctggccaacatggtgaaaccccctctctactaaaaatataaaaaattagctgggtgtggtggcggatgcctgtaatcccagctactcaggagcctgaggcaggagaattgcttgaacccgggaggtggaggctgcagtgagccaagattgagctgctgcactccagcctgggcaacaagagcaaaaaaactctgtctcaaaaaaaaaaaaaaagaatagaagatggcaacagcagagcattgcatacctgccccacttctccccaccctccattgctttttgctaggcaaacaccttcaaacttaacacttttagctctttcttgtgtttactttcctatttccgaaaagcactgctagactctcatttattgattttccagtttagatattatctagaaggttgggatttagcacccttgcatcacttcctatacgtacatttgtcccctcacctttcatcccaatttagtgttaacatacttggattaagtccatattctgcattttcattattatggctgtaaatcttgatggctgaactaagtgttgtaataagatggcatttcttttttttaatttattttttattttgagagtgtctcattctgttgccctggctggagtacagtggtgcaatctcggctcatactgcagcctccacctcccaggttcaagctattctcatgcctcagcctcccaagtagctgggattacaggcacctgccaccacgcccagcatatgtttgtatttttagtagaggcgggatttctgtgttggccaggttggtctcaaactcctgacctcaagtgattcgccaccttagcctcccaaagtgctaggattacaggcgtgagccactgtgccccatctagacggcatttctttgtaagaacaagcttttatttgcttggttttcattgcttctccaggccttccagatcctttaacagttttataagatgtctcttaatccagttttcccaaaggtaatctctaccagataatccagccgttcccttctttcctggaccctcctcccaacttccctctgtcctccagtttagactggatgctttctatgcctgccccaaaatattcatggagggtcctgtttctcggatcccatgctacttttttttatgggcaggtaccttttttttttttaatttgttttggtggagcacatcctcaagtagctttctgagaaagagcgcatggaggtaaatggtttgcctgtctcaaagtgtctttattcttccctcacatctgattgatattttgatttgatatcaacttctgggttggaagtgactcttcctcagaatgttgaaggcatttttctgttgtcttctagtttccaacattgctctgaagaggtcccataccatttggatttgaatgtgaccttttaaaaaatctggaagcttttaggactctttctctttctctctctctttttggtgattttaaattttaaatatatgccttggtctattttaatttgagggagcactcattggactgttttaatctagaaacttgtgcccttcagtgattgaactgttggtgtattattgatttgataactttcttacattttctctttctggaacccttaatattcagctattctctcactttcttatttttaaacattttacacttcttcatctctttctcttttcttttctatcctccctctctcccttctctctctttcactcccttcctctctccctccctccctccctccttccctcctccctccctccctccctccctcccttccttccttccttccgtccttccttccctccttccttccttccttccttccttttgagtctcgctttgttgcccaggctggagtgcagtgccacaatcatggctcactgcagcctcgagctcccaggcacaaatgatcctcctgcctcagcatcccaagtagctgggactacaggtgtatgccaccacactcagctaattttttaatttttctgtagagatggggttttgccatgctgcttaggctggacttgaactcctggaatcctctctcagtctcccatagttctgggattacaagcgttagccaccgtgcctagccatctctattttctaggaggtatctgactctactttacaatccctctattaaatttttgatttttttcattgtacttttaatttcttgaactttctcactcactaaatacacattgcgtgtctcatatctgaaatacttgggaccagaagtgttttagattttggattttttttttttattattttggagtatttccattatacttaccagttcagaatccccagtctgaaagtccaaaatctgaagtgctccaaagagaatttcctctgagcatcatgttagtgcccaaaagttttggattttggagcatttggattttgggattggagatactcaacctgtgcaccttttgatcctattcctgttttgtgggtacagtgtgttctcttatctctgtgaggttattacttacacggatttgacttttttcttctgttccctgaaatgtttttatttcctttgggttatttaaaaaaatatatttgtttcatgttaacagttttcttggccaggcatggtggctcacgcctgtaatcccagcactttgggaggccgaggcaggcagatctcttgaggtcaggagttcgagaccagcctgaccaacatggtgaaatcctgtctctactaaaaaaaatacaaaaaattagctgggcatggtggctcatgcctgtaattgcagctactcaggaggctgaggcaggagaatcgcttgaacccgggagggaaaggctgcagtgaaccaagattctgccactgtactccagcctgggcaaaagagagagactctgtctcaaagaaaagttttcttaaaatgcattggctgtatttcatatatagcaaggagatgcagagacactaattgggcagtttgtggacttgggcaggacttttccaagtcactgctgaaggactggttcagatggggctattttggggagatcctctaatgtcactatctgaggtcatttttctgagtgattcagtttcctgagaggaatcctctcgacttttcctgggagagtgtatgtctggctgcagcattccagcatccaagtgggaaaggggcttggcgtgtttcttacccttcaatgtgtagacttttgcttgtccccttttctctgtaggtccttctgccttgggccttcatgtgtgtccaccgttcctgggccagagcctcctggttcaccctctccaggaagtgatccctggccctctgctgggtggcaggtggccgtcacttggctactcagggttggggaggggctctagggtctgatcggttcttacagactttcagccctactgtcttcagccctcctggccgtaaggccctgaggagtccctgcaaactcagttcctgagccttttcgggcttctgcttctgggtggttcccccctgcaggaatctgactctcagctttcatcactctagcaagtcagctactgcctggccatctgcttcccagcttccagaatcttgttgacatccttcattactcatcatcaccccttatggatttatgccttgtttatttcctctactgtcattatagtggagtcttggaaggaagcagcgataaatctgtctgctcaatgtgccatgtttttctagaagtccactcactgtggggcttaagcagggatgtgaccaggtccattagggatgtaagagcaaggatactggcctccagtggaagagggattactggggtggggggtgggattggaagcagagaagagttttgtttggtggttaagaacctagactggcctgtccaagagggttgacctgaagaactctaagaacctttctgggctgacaggtgctttatgggaccttggggagaggtcacagcatttcgccagtgtcaacttggacctgggtggggaggaggggaggccctggtccctggtttcctcaaagccagcatttctacagggagagaggcaggctaggtaacatgtggggtccttcacttcaccccatggacaccccatgcagtgactccatgaccagatcccaggggtggccaggggagcgggcccacatgtctctcctgtcagtggtgggcagctctttgcagtcttgaggtgagagtgaagcttctgactggagtcacctactgtctgctttgacctcttgtgggactgcccagccctgctatagttagcttcaggaggggcgtggaggggaagggctgatggtttgggggatccgggtgtgtcggcagtgcagagaacctggcagtcagcctgccagaggaaggaagggctggctgacggccaccttgagtttctgactcccaagacagcacctgggcctgattctggcagtggattctgtgagggtcaccttatgctcccaacttctcccaacatccagggtgggctgagaggttgttgcggcttcagctgcccagcagcaggcctgcaggagccacatgtgcagcgagtcagcactggggcagccaggaaacaaaagggctcggctgcagcccagggactgttggtgccgggatgaggcgcattggacccctcagcccctgggtcagaggaccccctggctgggatgggtgagcccccagtctacctcctcgagccacggaatgatggcgggaaggagggagcccagggccagctgaccccaccacccccggctgacactctgccccgggtgcaggcccagggaggctcagggagccccaagccgcaggagaacttgggacactcctttctccctgccaggcctcgctgccatggttttgaacttgtatgtggggtgaagtatttgaggccaggctcgcagttgaatgggaggagccctgcactgggggtagcccagtgagtagacacagcctggtgcaggcagcctgggcctggctccaggtcctggccatcacgtccctcttgcgcgacccgggacaagtgacgtatgggccctgagtgcatgagggaagatgatggtagagtctgcccaggatgttgtgaggagcaaatgagagggtatgcccccagcaccctggaccagtctggcacgtggtcatcttgggcactaggactgcatccagcagctgctcatctgccaacgcccatgttagaggatctgtttccagccatgatgggcagtctgagtgattccaggaggattccagggttctcagtagaagtctggtcaccttggctttcttctccgcagctctgggcagagtcaggggcctgtcactggccaggggacttaggagaccacacagaccacccaccccaccctgggtctcccagctgccaggccccctcctctgaaatctgggcttcgggattccatggtctgatccaccctcctagcctctctccacacctgtcttcagcactcttggccctgtttcctgaccctttcgtgttctcccagcctctccacatctcggagtgtctctttctctccctgctggactccaggatccatcacctttgcccttcttccctgtgcgaccccctgcctgtcccaatcaggactgtatgctcatcccagccatctggcctggcaccacctaccctgagtccacccagactggagaactggagggattttgcctccccatctcccctgcctggctagaggccccaggtcccatgggtcctgcctccttccatgcttctgcccaagtcgtggctgcctgggtcatccccagccccgcatgtctgcatggctcaattctccccagccactgctgccccacagagggccccaaaccttcctccaggacagcaatgagctgtgggtgggctggtcagcatgccagggcactcctgctgctaagccgttgtagtggccgcctaaggtccagcaggtacagcaggctggtcactggtcccagaagcagtagcatgcctgagggctgtacagagtgaggcaggggcagaagcaggtgccagctgggcctgggccgccctccccagggccccggactccacgctcgctgcctcgtggtggtctgggcagccttgtcttcgccacaccgcagcagcaggagcgtgtggtggacacagatggcacctgctcgtgtctgccagtttccccgccaccgctgccagggaatgccagctggaggaaggcaggagtagatagggtatgacagaggctggaggccagccctgttggggagtgggggaaacaggggacaggcacggatgccctaggctctctcccaggggaggggctgctttccagaccttgcccttccacagatgacccgaggtctctgcctgggtggggccgtcggaggctctgttgtgtcaactgtgatgtgatattctccggatccttgtcgggcctggctccagggtctgggctcagacacggaggctgcagggtcggagagcagggccacatgagggtttggcggtccaggaggccttctgagggaagggccctggcagcgtgtgcagaggcctgggattggggttggggttgtttagccagctggagtgcccaggaggtgagatgagattggctgggagggcctgtgctactggctgcaggtggaggatcggctgagccgagcggggaggctggagtttcctacagttgtagggctctgtgccccctcccacctctcctcctctcctggccccaccgaggcttctccgatgggtctcacaggctgcgcccccctccatcctcccgtcccatctctagccatgggtggagcctgtgcctggatgacccgcctgccaaggacatcattgacttcccatcagtgctgcctggggtcctctatgatgtgagccaccagtgccacctccagtatggggcctactctgccttctgcgaggacatggatgtgagtggggccggtgtgggtgtgggggtgtggggacccgacaggagggcttaggggacagctttcaccagcctgtggatgccagcttgggagcaacctcgcctgggctgggctacgcccctgagtgacactgtgagacgtcaagtggcctgtgggagaggccagggatgggcggccacagacccagctctgaattctgggtcaaccatggaccgactgtgacccctcgggcaagtcccttcgcctctctggagctggctcataagagggaaaaggaacccctgtggggagggtctatttatcctggcgaagatcgcctgaagtgatcttctaacaggagtgtttccagaggaggcgctgggccgggagaggtgtggacagctgaggaccactctgagcagtgcagccccgggcgccccacaccaccacgtggtctggggaggaaggtgggagcagacacacaagaagggacctctgggggtctgtgggcccctgccatgtggaggggtgcccagggacccttggggacagggaggggggcagggtgggtggcggcactggggagggggtgaggctatggcccatgccctcctcctcgcagaatgtctgccacacactctggtgctctgtggggaccacctgtcactccaagctggatgcagccgtggacggcatccggtgtggggagaataaggtaggcgatgttcccagtcccggcagtggatgtgtgagaggccagacctcctgctgtgaccgggccctggagtcagccccggctcacagagagccccatgccctctgcagcccaagcccccgtctgcaaagtggaggcattggggccagggcttgattccatgattctccagggtgtcttcagctgagtcagcacgtgggctgttttactccctgctcagcgcctccatgtggcctgggtcacagatgattgtgatgattgcgagggggcctctctcaccttccatccttcccctctgtgccttttgcagcattctcacacaccttgttctcactagggtgaggatgactgataggcttgggggtggggtggctctacctccgtctgtctcggtagtggtgtctcaatggggagtgcatacctgtgggcttccagcccgaggccatggatggtggctggtctggctggagcgcctggtccatctgctcacggagctgtggcgtgggcatacagagagccaagcagcagtgcatgcagcctatgtgagtgtggggcccagggtgccctgggcaatgggacagagggacccaggcagtcagccgattgcaggagcttggctctgtgccagcccctggctcttagaagtgtcctcataatggtcagtctgagtgtccaggccaccttgagtcactttcaaggagtgttctgagggctgacagggtccccactgctgacccctttgcagaaagggggacactgaggcccagagactggagagactcagcagaggccacgtggcaaagcagctgctggctggaaggaggcaggagagggcagtggggaagagcatgggccctggaccttagatggctcagggttcgaatcccctcttcaccccttctctgggcctccgtttccccacctgtataatagcagtgcccatccagtaaagttgtagtcaggggcaaatgcagtttatgcaggccagcccctcagccctgcagctcatctgtagtgggcactcagcaggaggggcttggtggcctcagaggcacaacaagggcctgagatgagatggagcagctgggaggatgggacagcactgaaggggtggcctgaggtgagtgacttcacctctctggatctctgtttccccatctaaatgggggggcgcagggggtgtgaagatctggtgagaagcagaggccagtggtactgtagaccgaggcactacccggctgatcttcacttcaggaggccacccggggcaggcatggggttcacagtcggccccacccagggccctgcgcttacccaagactggcctgtgcccctccctgcctcctggcctccaggtctgagctgagtggaggccagcgaccctggcctaaatgtggaggatttcaggagctgtgctccatcatacctttcagctggctggggccctgggcgcttcctttagacccaggctgggggtactgccaccaggaggaaggctgaggactcaagggctcgttaggatgctggtgtcatgggctggagactcggattagtccctccagccagtgccagtcatgcctgcagcttgtcccagcttctcaacagccctctgcaggggcagccccaaccccactttatacatgaggaaactgaggcccagagggtggccgaagacttgtccacgatcacacagcaggttgggggcagagctcaggcttcctgctgccacctccccacaggtccctacagacagggagggtgtgtctgggccacagggtgggcaacccaagggagggaagcagcgtgcacaaagctgggcagcagggatcttggggtgtgggtgcaggaggaagctgcttgctctgggctgtggccatgcagtagcactcactgggccctcactggggtccaccccggttctccccacaggcccagatacaaaggcagatactgtgtgggtaagcggaagcgcttccgcctctgcaacctgcaggcctgccccgctggccgcccctccttccgccacgtccagtgcagccactttgacgctatgctctacgagggccagctgcacacatgggtgcccatggtcaatgacggtgagtgctgcctcccatggaaacattgagactcagagggcggcgagcggggtgtgggtccaaggttaccctgtgatgcaagcaggagacccagtctccaccccaagcctgggccactcccactgtcccctggggctgctgctcgcccctagctccccaatctgcagccttgcagatagctaccagcccagccggagcctccagcatgtttgtgctgcttgggagcctccagcctgccatggatgtgtgtcacggaggggtcttcctggtggcctccatactcccgctccagctgttgctgatgactcttctacttgggcccccagtgaacccctgtgagctgcactgccggcccgcgaatgagtactttgccaagaagctgcgggacgccgtggttgatggcaccccctgctaccaggtccgagccagccgggacctctgcatcaatggcatctgtaaggtgtgcctggttaggaagaggctctcccagcactgcctgcccccagccccactggcgggccccaggttctctcctggtcctcctcgggccaccctccccatgctctaccattgggcttcccagcccctaccctctatgacctctaaggcaaagcccctaccacgcctcctggcactggggaccccccccagtcaggcctcgccccactgcgtctccttggatgcctgcaccagcaccgccccagccaggaaaccggagcccaggcagtggcttgacctcttgctggctggctgaccccaggcagtggcttgacctcttgctggctggctgaccccaggcagtggtttgctccctgatagaggggttaaatgaggtggcacaggtgacatgaagggctctgagccccgaagagtaggcctcagtgtttggtaacaatttatattcttatttttaataacaacgatggcctctcctctttacccatgtctccagccacctacttgtccttgcttcttgccctctaaaccactggggtatcaaggcctgggctccgaggaggaccaggagggaggtgccaacccccagtgcctttgacgttgaaattccctgcacgcgctgctcaggagcccgtggcgtgtcagatcccctgcctgcccgcaggctttgcagaactcttcccttctcttgtctcttgtgatgctcatgacatgcctttaagggaggggtgggtctccctgtctcacatctgaggaaactgaggctcagggaggtagagaagttcacctgggtcagaggcacagctggggtggggcagggccagagagaggcctcccgacccccactcccagctttcttctcctgaccctggctggcccccggggctggggccacagagggctggccgccagcaccaggggcctcccctcctcgtgtgttgcagaacgtggggctgtgactttgagattgactctggcactatggaggaccgctgtggcgtgtgccacggcaacggctccacctgccacaccgtgagtgggaccttcgaggaggccgagggcctgggtatggggtgggaccactgtggggaggggtgtgctcttcacctggtggccccttccccatctcccccgggcccctgtccttggcctcgtggcccccacccagcctagagatggctaagcagggagggcttgctggggtggattcttgcaggagtcaggggacccctggcccacacgcagagacctgtccccatggggagtcttcctgtcccagagaccccaggcagggccaccccgacttgtgtgtggcccctgggcctttcaaagaatggtcgtctcctcctgaatcttctgagacccccagctccatgccctcacctctggtctgttttgcacatgttgctgaagtactgactgtgtgctaggtgatgaggacatgcaggtgaagcgctcagtcctgaagggggacagaaccttctggtgtgatcagtgcagtggagggaggcccagagggctgtgggagcactgaagaagaaggtcctggcctggggaagtcagggaaggtttcctgcaggaggcggaagttgagctgaatcataaaactcagaagagatggaatgggcattccaaatggaggaaagagcttgcgccagagccctggaggcaagaagggaaggcagggccagctatggggccttgagtgccaggctgagaagcttagatttcatcccagagatgcagtgcagtgtggtggataaagcactggccctggaggctgcttatattgcagcaggacgctcatgcacgttactctccctgtctgcctcactttgctcatctgtaaaatggggttaacaatagtaccatgctatagggccattacccatgagcttacacatgtgaagtgctgagagtagtgcccggcacgtgatgggtgtgatggaagtgaatgaataaaagcaggctgcgtggggatgaggagggtgtcccaggagaaaggcctgggcactttggttttttttagaaagagaatgccagccggcccttagagtaggggatggatccagccttatgatgagaccagtttaggtccccaagagaggagtgacggggcatggccacggggtcaggatttgtggcacctccgcaaggttttggtgacccatgacagatccgagcaatttggggagctcagactttaaagctaatggcgaaatctttggcatcagcaggcggaggcaagtggggagagatgtgaggggagcaggtggggataagcaagcttctcaccccaggcacaacccttgcctgacagggtatgtggacgtggggctgatcccagccagcacacgtgaggtccgcatccaggaggtggctgaggctgccaacttcctggcactgcagagcgaggacccggagaagtacttcctcaatggtggctggaccatccagtagaacggggactaccaggtggcagggaccaccgtcacatacgcacgcaggggcaactgggagaacctcacgtccccgggtcccaccaaggagcctgtctggatccaggtgcctgcctcccgaggcccaggcgtggggagcagaggcggagtccccaggcccagcacctcccatggtaggtctcgtcctggaggagtgagccctgggttagtcacagagcctggctctgagccagaccctcctgctgaggcctctacctcggtttccccatctttaagatggcccaactgtgtagctgcagttcacagaggtggctggggtcagctcctttaagactgggtggatggagaagacacctcgtgctcacgggcccccgcctgcccacccagctgctgttccaggagagcaaccctggggtgcactacgagtacaccatccacagggaggcaggtggccacggcgaggtcccgccgcccgagttctcctggcactgtgggccctggaccaagtgtacagtcacctgtggcagaggtgagaagtggggcaggcacagccccgccagcaggggcttcatctctggacagggacaccggcttcagctcccagctcactgctgggccaccatgggtttagaagtttgcttctctgagcctcagttccccatctgtgagatgaggctagcaaccgccccatgtcccaggcccactgggagggtaaatggatgaggcaggtgggtgctggctcgcggcgtgtgctcagtgtgctgcagctcttggcgttctccctccagtggacacagctcccccttgattttgtccttgctcagctccggcaggttttgtgcctgcatttctgctgcgtcccggagaccagcccaggcccctcaccacactgacttatttccctgaactatttatgaaaagtagggcaatttcattaactccgactcttcctccccatatttccctcagtctccccccatgctcctcagtctcccctctctgtctctttgtctcctccccactgctcctcagtctcccctctgcccctccgtctcctcccatactcctcagtctccccccatgcctctcagtctccccccatacccctcggtctccccccatacccctcggtctgcccccatacccctcggtctccccccaatatccctcagtttccctccggccctccagtacccccgccacgcccctcagtcttcctcccccggctcggtctcccccgccattccttggtctccccccagccccccagtcccccccgacgccccttggtcttcctccccctgctcggtctgccctgctgttcctcgatctccccacacctcagtctccccctttgtctcttagtcctcccctttccccctcagtcttcccatcgttgacactcagtatcctcagggtctcagaatcgggaatctgatatacagacgtttgagcattccttcaaatgctattatgatgacaaagtgaaaatggagaactgggcagttaccttccaaagctaggaaacccattttatctaatacagctgtctttattttattttattttgttttattttattttatttgagatggagtctcactctgtcgcccaggctggagtgcagtggcgcgatcttggctcactgcagcctccgcctcccaggttccagcaattctccttcctcagcctcccgagtagctgggatttacaggcacgcaccaccatgcctggctaattttttattagtggtagagatggggtttcaccatgttggccaggctggtcttgaactgctgacctcaggtgattcgcccgccttggcctcccatagtgctgggattacaggcgtgagccactgtgcctggcctaatacaggtgtctttaattggacaaacgtgaaaaccaacaaatacatttgcagcactagacatttggggaattgcctttcagcaaattggctgcttcgcaggtggaccacttaggagcgtctgcagaggcaagtgccctgtggtggctggaagagacaggggttctttgtctcaggcaggaagtcccaggtgcacagtccaagctggcgggacctggagctgactggccctcagccacaccatccttgccatagcagcctcccctccactcctgcttgccacagatggtgtcctcccttccagggctcttgcagtgttctaggcaagaaggagagaggaaagggctgactcccagcgagggacttgtgcctttttctcctgagccaggactgtgtcccagacccccctagttgcaagggagcggcagtggggtgtgttttcagcaggtcccactgctgccttgaacaaaatcagactctgttggtgaggaaagagggggatggatgtgggactggcagctcaggggagggacaacttactctcgggaccacggggcagggggtggagcagagaaggcagagccaccagcagacggggtcctgcagctgggcctcaacaggcagtatggaagtgagtgtccaaggtgaggaacgtggctgtgcaaagtccccaggttggacagtggcagagaatgtaaaggactggagcagtgccaaggctggtgtggggatggagagcaggggctgtccattgatgccccatttcttgtccagacattctctgatccattgggaagggtgtggatggtgggaccgtgtgtcagtggtccctggacacactgggccctgaaggctcaggcagcggctcctctagccatgagctcttcagtgaggctgacttcatcctgcgccacctggccccatgcccttcacccgcctcatcacccaagccaatcccaggaaggagcagagggagctggtctttcattctcttcccaaggctgaagccccagaccccggtcacccctcactccagcctgggccaccctggacacttatggtcctcctctttgggtccctggatgtggaaataggcctcaggtcacattcagtttccctgaggggaaggtggcaggagccacggctgggtttgcatgctagcagcagctggcatggatcgagctcttaggatgtgccgggcacgggctgagcctgcacatgcaagaacacatgcagtcctccctccaggacatggaggaggcaggattgttgctcccacttcacagaggaggacgctgaggttcagagaggccaaatgagctgcccaggcatctcagctaggatgcagagggtctgggcacccaacccactaaacctccacactctgccacccctccaggggcagtcagaggggaagctacataggagagggggtgggtgagaaccaggaggacagcaaggaggcgacggtggaggtctgccttcatcctgacatgggcagtaaggcatcctgacatgggcagtaaggcgctgttctgggagggttctggcagagagggtgtctttgggtcttgggcggtgggcacctgggtgccagtcccaggctgaacgccatggcccctaggtgtgcagaggcagagtgtgtactgctcggagcggcaggcagggcccgtggacgaggagcactgtgaccccctgggccggcccgatgactgccagaggaagtgcagccagcagccctgccctgccaggtgagcccgcccccatcccctaccaactccccacccccaggcatcctgggtctgccacaggcccctacatctgggtccccagaggccccagggaggagcagagggagccgggctttcattctcttcccaaggctgaagccccaacccccggtcacctctcaccccagcctgggccagcctggacacctatggtcctcctctttgggtccctggatgtggaaataggcctcaggtcatgctcagtttccctgaggggaaggtggcaggagtggaggggctgtgccttgtcaccagactttgagggcaggacacttacctgagcttggagctctggagaatcatccactggcttctggcactgcccaaaccccgagggcctggaaacccagcctggccctccctgctggtgagcctgtcaatgccacctgtctgatgccatactgatgacacctgtgtgccctcagcaggtggtgggcaggtgagtggcagctgtgctccagctcctgcgggcctgggggcctctcctgccaggctgtgctctgcatccgcagcgtggggctggatgagcagagcgccctgaagccacccgcctgtgaacaccttccccggccccctactgaaaccccttgcaaccaccatgtgccctgtccggccacgtaggctgtggggaactggtctcaggtgagtgtgggatgggaaggtgcccgcctccagccccacccttggtcttcagctacagggaggcagacagccttcctggagaccttgtgggtgggagggaacctgggcattccagggtccagcccctgactctaaagcctcagggatcaggaagcccctggcaagcatggccacagtcatggccttgagctgggaagggccagagagggctggctggggtctctgccactctgacatcaggcagtggacaggttacccagccttgccccagcgtcccctggcagcctgcctcccaggctaagcccctcaccctggcttcccctgcagtgctcagtgacatatgaggaagggactcagcaccgaaatgtcctctgcatcagtgacaccggtgtcccctgtgacgaggcccagcagccagccagcgaagtcacctgctctctgccaccctgttggtggcccctggacacactgggccctgaaggctcaggcagcggctcctccagccacgagctcttcaacgaggctgacttcatcccgcgccacctggccccacgcccttcacccgcctcatcacccaagccaggcaccatgggcaacgccattgaggaggaggctccaaagctggacctgccggggcccgtgtttgtggacgacttctactacgactacaatttcatcagcttccacgaggatctgtccttacgggccttctgaggagcctgatctagacctggcggggacaggggatcggacgcccccaccacacagccgtcctgctgcgccctccacgggtagccctgtgcctgccacagagcctcctgcagccaaggaggaaggggcaacgggaccttggtccccgagcccttggcctagccaggccggccgctccccacccccaccctcagagcagacccctgggaaccctttgatcaatttcctgcctgaggaagacacccccataggggccccagatcttgggctccccagcctgccctggcccagggtttccactgatggcctgcagacgcctgccgcccctgagagccaaaatgatttcccagttggcaaggacagccagagccagctgccctctccatggcaggacaggaccaacgaggttttcaaatgatgagggacccaagggctgcggagcaccccacctgcccccgagacccagccccacgctgcccactttgtacccggtcagcagcacccactcctctcctagtcctgacgtggcggagctgtggacaggagggacagtagcctgggagtcagctctggagggtggcctggggcctgtggacagtgaactgtggcccactgttagggtggcttctctccctcctcctcccatagcccctttgccagagatgaagggcaaggacagtcccctgcagccggggacttccaccttcccaaccccaggaccaggctcatgggacctgcagactgtggcagtgtgggggaccttcctccccacaaccctgactggcctcgggcacacgcctgagcctgccctgaacccaggacccaagggtcagcctgagtccctcagccctgaggtgcccctgagctctaggctgctgtccatgccagcttgggacagccccgccaacagccacagagcccctgagacccagccactgcctcccagcctggctgaagcggggccccccacggacccgttggttgtcaggaacgccggctgacaagtgggaaactggagcgaggcaagtggtgtgggctgggcgggcagggagtttgcgcaggaccttggtgactatttcctcatctgaaaatgagcagagtgggacgcaggcgccgtctgtctcgccttccttggggcgggggttcccaggattaggggaatgaggggacctggggcccattcctgggcagcacagggggcctcagggaaggcaggggcaggcacactctggcagcacagcatgccccaggatggagctggctcagacagctgtgcagtggggagggtccctgtgtggccaccaggcccagtcctgcccagcaggcagcagcttccctgaggctctgtctggctcctccaggctggactcagcccactgctacctggctctgccctcagtggctccaccctcctttggcagtgacctgcagacgtctgagctgcatgaaagaagctggctagtgccccctccctgggtccccagatggtcactgcaggagaagcaagcttctgttcagattcctaattttggggtgggaaggggcaggctgaggcccacagggcttgttttgcgcggggataggcagcgatttggctgctggtaccaggacccagccttccttccctggtgcctctgggaagcgacgaggctggtcaggatagctggtcaggggtgcccacagggtctcctcccccgaacctctgcaccaatgacactggcacacaggccctttgtcccatgtgagcagggacggctggttgctggggggatttgacttttcattctcatggtcttcctgggaggtgggtggaggagcctattttgcaaataaggaaactgaggcccagaagagggcccctgtcttgctgaggtcttgctagcctaggtgggtagtttcctggctgtggaggcctggcgaggatgggctctgcctggctttcacgggtctgtgccccgcagtgctccaccacctgtggcctgggtgccctctggaggccggtgtgctgtagctccagccgggatgaggactgcgaccccgctggccggccccagcctgcccgccgctgccacctgtggccctgtgccacctggcactcaggcaactggagtaaggtgcatgaggatggagccaggacaggcatccccagggcatggggtggagccctggttccccacggcctgtgttccgagagcggcagggaaggggagggctccaggctgcatgtctatgtgcctgatcgcaccggattccgaatctcttgggagtcatctcatctttgtctggcttggcctgtctcctttcctctgtatctttgaccccatctggacttgttcctccctttctctgtctgtcccagcccatggcagcccctggccatgccaccttttgcctggggcctgccagccttggcctctcgctggggctcttcagggatttgcccccggctggggcgtgggtctgatgcctttcctgccacacgcctcacggggtcacgcctgtgggcctgcacgtggggatgtgtccacacaagtctctcggtccccagtgctcccacagctgtggcagaggttcctcagtgtgggacatgcagcatgtggacacatgggccctctggccactgtggcccttccattgtcagcctggacctgccaagctgcctgtgcactggccctgcggggcccagccctgcctcagctggtacatgtcttcctggagggaggtgaggcctgggcgttgagttggggggaggggacaccctcagaccctggctgtgccctgactccttccctgcccacccagtgctccgaggcctgtggcggtggtgagcagcagcgtctggtgacctgcccagagccagacctctgcgaggaggcactgagacccaacaccacccggccctgcaacacccacccctgcacacagtgggtggtggggccctggggccaggtgagccaggctgcgggggggagcagggagcaagtgcttggtagcgcctggtcagtcctgggttgggtgaaggagctgtggagtgtgtgctgtgagccaggctgtctgtggcccctgcacatgcagcagtcactggacaaagccctgccatgctggtgctcacacctgacagggagaaacagacaaggaaagggcatgtgtgctgtgatgtcagggaaggccttccgaggaggggtctggggttgagacccgagggaggagtcagtgatgccaaggacagggatcgaggggacagcaggtgtgaagtctgaggcaggaatgatgagcttggggagatcagggagcccagcaaaggccagcggcagaagggggcagaagaggggcctcgtatgggcaggacaccttctgctgggcctgtttggaactgaggggttcagaaatctcagatttgggccctgagctgggtccgggagtcagctgggccagcgtttgagtctgtccgactggctgctgagtgactctgggcaggttgctttgctttgctgggtcagttttctcatctgtaaaattgggacgctttgggagaggagggtcaggaggattaaatggaggaacgcaacaaagcacagggccgggcacagcacgacactggcacagactcagcacatgtttagggctttcagacctgcacctgttaacaacaaagcctggcgggctgggccccggctgtgaaattgtctccacccctcctgcccatgggctgcggcaggtcctctgccctgtccctcgggcacagcggtgtctcgcccacgtctctgctcactgctgcatcagggctccatcccggggcccctgcccaggcctctcagtcatgtcccgtgtgaggggctcactgccctgccgccccaagggctgtcccatggttctcatgccccttccctctgcagcagccgatcccacaagtgagagtggggttccagcaccaagtgggctctaggaatgggaacaggtcctccaggaggcactgagagggcggctgggagcaagggcaggccagtcaggcacagggcgcagggacggcttcccagaggaggtgtccctgcccccactgctagggctggccctggagacactcattcctcccctgctccccccagtgctcaggcccctgtggtggtggcatccagtggtcacacactggtcaagtgtgtcaacacccagacggggctacccgaggaagacagtgaccagtgtggccacgaggcctggccttgtgagctcccggctgtgtggcaccgaggattgtgagcccgtcgagcctccccgtgagtcccccgaccccaagctctctgctgaagtgaggtggggcgggaagggtgatggggaaattgggtcttcaaaccattgcacccacggcaccggctggctccatctgtagtctgggctcaggagccactgaaaatcctgatgccacaggatcccatgctggaggcttggctgtgctgggagtcagtcaagagaagtcccagctacacaacatcccgcaggcagctttctgacctccggtgagtagagggagtggccttggcccctgatttgctgtgtgaacctgggtaagctctttcccctctgggtctcagtattcccatagtgagaccagggatgtccctgaagctgtgtgaaaactgggcctgggtgagtccctgtcccctccccagccctagcctgtccattccctggccagaggactgcctagagtgagcaatggaaccacaggaagggcctcccttccagggtcctgctaatcccagtggtggggggtttcctggccagctgggtcctggtggaagggcctgagctagaggtggttctggatatcccaaccccccacctccaacacacacacacacacactcacacacttcctgcagccccagctgctctcagcagtgctgagggcaggaaatggggtggccctggagtgtcacctgggctcccctcaccagctgtgtggccttgggctccatttccctctcagggccttcatgtgctgaataaaggggctgccaagccccatccttgcataagtgaggtctgggcatgaagggcacagcactgcgtggggatccaggtggtgctcagggaaggcggctttttcccctcccgcaaagccactgtcatcccccattgcaaggtcagggagagggcctggggctgaccctgccagtctaaggaatccaggagctgtggcctgaagagctgcggcccctgtgctattggctgtctgccccctgaccctaggacagagtcctcagccacggccctcaaactggcattcggggccccctgcagtctccccagtctgccttctccccttatccaatgcgccttctctacctgcgctggctcctgggcagccctcatttgggctcagagtggcccctgccatgcctcgctgccatgccttgctaccctgcctctggcaggggtggccttcctgccacaaaccccattacctcaaggccaagtggcagtgcccccaccctgtcctgcctgccctcagcacgcacccagccagcatctcagagcactcctgtgtgctgcctgagctgggtgctggcatcacatctctcgccttcatggctagagctggccacagggagtggggtggttatgatcccaggggatgaggaccagatggagcagagaacaggaactgaggcccctgggggcctagaaccaaggacagatggcccaggaggctctgggcttgtaaggtctcccaggggcgggtatgagtgggctgcagggagtgggctatgggggctggttaggtggctgaactagaagctgtcctaagtgaggagttttctgccaccagtgaacagtggaggggcagctgggaaggtgtcttggactttgagacctggaattcccaggatgttttgctggtctgtgggacagttggcgggacgggggaaagccaggaaactccagagtgtgcggtcgctgcagtgacacagcatggccacatccatttgctgtggaggtggggttgacagaggagggaaccaaggcccaagaggtgaagcagcttgtctgaggtcaccccgggcgaccaggatgcaggcctgcagatgtgcactttggagctctgcctggagctggggtggaggagcctgcctgctgcctcgtgccctctgccgggcctgagggatgtccctggcacagggctggctgctgtcctcctgctcttcctccccagggaggtctgctggagtaagcagggcccaggcggcaggtgggggctgtcagcagtggcagtggcatcaggagcaaggccaggaggctggagacaagccacttcccaaaatagctctgataaccacggggcaggagggcccagccaagcctcagccctgacaaccacagcctgcagccggcctccctccccactgggcctgggcttagtccctggtttccgctgacagcctgtagggcccactcactctaggcttcgtggcccacctgagaagtgggaggctggcctgggagatgcgacctgtgactcagaacccgaggctgagtacagcccctgtggctggaggtggtcacggaggtctggcaggacagatgcactggggcagggggcggtggcgggagtcgggggcagaggccgctgcaggttggcaggaggccccgggaccgcagttctgtgccaggatctgtcggggaacaccaggggtgagcaaggatggagatgggatggcagggcgtcgccctgggcaggctctttaacaggcatgtgagggggtcagggtgcggtctcaggacctttcctccagaaacctcagcccagcagcgcccgttctcgagtcctggggtcggccgtgagtaggtgggacagagacaccaacagttggagacctgcaagtccagtttgggagccgctccagaaactggggctctctgcttggtggggagctgctggagcctccttgaggtggttggggtggggagccaggttctggataccccaaaccactggttctgatgcctctctgaccccccactccaggctgtgagcgggaccgcctgtccttcgggttctgtgagacactgcgcctactgggccgctgccagctgcccaccgtccgcacccagtgctgccgctcgtgctctccgcccagccacggctccccctcccgaggccatcagcgggtcacccgccactgacggtgccaggatgcacagaccgaccgacagacctcagtgcccaccacgggctgtggcggagctcccgccccctacgccctaatggtgctaaccccctctcactacccagcggcaggctggggagctcctccccctcgaaaaaggtatttttttattctaacagtttgtgtaacatttattatgattttacataaatgagcatctaccattctaaagcacagtgtgacttcatcttggatttggggaatcttaaaagtgagaaactcttcccccgacccctctgcccaaaactccaccgctgcagcacctcggcaggcgcggcttttcacctgctcctctggggcagatctgcagggggcagcgtagcaaacgagtccctgagagcatggcatctggtgaggcacggaaggcctcggaagccagggggctgctgcccagggaggcctgtctgcagagggtggggttctgggggcaggaaggtcttctgggcaggggcacagcttggcccttacttgctgcctgccttcagctcaggctcccagccttccctggggccccactctgtggtcctcagagacctgttccacagggattgagcccaccttgtcacttgcagggactgccccctggagtggtggggactggggcccccatgggcacctccctggctctgtctgttctatctgttgactcttctgcaaaaagcgggcagagaggggaagagcaggctggccaattttgccctactgtgtccccacgtgtcccttcatctctgtgcccagagatagggctgggctaattgccactgccttgggttggcccctttcccaccaccagcccaagcaacaggttcctaccatgctgatctatggtccagcacctggcacctgcctacccacagccccttcccctcccataaaatctagtcccatggagccagacagtagtgcccacagcagggaacagatgggcatgaaggtgctttgaagagggtcctggcctgaccaggggcgggaggctggagaaggggcggacactgtcctcccaggcccaggcccagccctggatccgaccctggcctctggctgtgagccttagactcagccgttgacaatttcctcctcagccctccccctggaaggtgttacgccccttctacaggtgggggacactaaggttcagagaggccaccctgcagcctacaggggtcacctctcacattctactctccagcgtatgacaaccctggacgaaaggcaaatgtagccctggagcctgcatgtggcagccgcagccactcagggctgggtgtatgctggggatggagaggacaccactgaaaatcactcctggctgggcgcggtggctcacacctgtaatcccagcactttgggaggctgaggtgggcggatcacctaaggtcaggagtttgaaaccagcctggccaatgtggtgaaaccccatctctactaaaaatacaaaaattagccgggtgcagtggtgggcacctgtaatcccagctacttgggaggctgaggaagaagaatcgcttgaacctgggaggcagaggttgcagtgaactgagatcacgcctttgcactccagcctaggcgacagagggaggagactgtgtctcaaagaaaagaaaagaaaagaaaaaaaattactccttagggactgagaccaagaaagagcatcagaggctgaaccccttggtgaagagcgtctgtcccaggacttggaagggagggaggggaatgtggccaggggggctgcctgcaggtgtctgtcctgctgctcctcaaatcaacatgctcacctcatttcacaccaacacgccccattctcagaggaggagcccaaggccctaagaggaagtaactggcccaaggacacatgccctagtgacacaggcccatcctaggcgccgactgcccacctccaagttccaggccactctgagcaggtgaaagagggagagggccccaagcaggccccagctatggctttgcacagagagggcagcctgccagagttcacgcaggaaagcaagttcctgggaaggctagcgtgagtcccagccccgctgtgctgaccgagggtggaggagcgtcagacgtgcttcctgtctgtctgcagcagccaggctggcccagcaagacctggggacccacgctctgagtcatgggttcccaggccttagtcagaactgcccctggtggcagtcccttccaaggggtaaggagcagggcctgtcgacttgctcctgacccacacactgaaccagtccctaggaacatcatcctgggcatgccatacctgtcgtgcagtctcagtcatgctgccagggcaggtatccagctcccagcctgggagtgctgagagccaaatccactgcaaagcagggctgatagtcagggccccacctcatctatctgtcggcaatccagtggtatctaggtgagagtcccatacacacggtcatcccacaacacactccacactccacaggccaggcggggacacacagcccccttccctccctcccaggtaccaccatagctgctagtgtgtgaccgaaggcagggtccctggcccccgctgaatcactatcgccgaccagcaggctcacacaccttggcctgttgctcctaggggtcgcctgtgctattcagccaaggggaccacagtgcctgctggcccagctgagctccgcctagcgagcccacctgcctctcctgccatggactctccctcttctgcttttcccagcaggaagggcccagcctcacctatgcaacctgcagccccacgcccgccaaccagttgaggctcccctcttagacttataagtctatggccagtggcatccagctacctgccctccctgccttccccagggtcccttcagaggaccctgggattttggaccacccagaggggcctctggcactcactccagtcatccatcccttatagcttcaccatttttggtttaagcagtgttccctttctatcaggcctggtggctgttgggtggggctccccaagcaagaggtggccctgggccgtgagttggaagacagggtgaccagagaagagagaagcccgagggggctgagcattcgtctgaactatgggtggactgcctgggtgccatgaaagaggccagcgtgtgtggggtggggagggccgccgcagtccccaggcactacctatgaagctctggcttctccctccatctccctcccctttcccttccagcccctcttttccaggaaccttgccatgcccacacctacgccctcccctccccggccctccacagctgctgcagcgcacccatactctgcacttgcctcaccagctctggcttttctctaacccgttttctctctgctttctctccaactgccagctgattgggtcaggcaagtccatcccatccggggagccccaggccccacttcgacctctaaacagattcctcctcttctcagagacctccctttccaagcctgcctgggtgggtgtcctgtgacttgacagtggctcccccagccccaaagccagcccccttcttctgtgacttagtctgttgtagtggtgagctgacacatccaggtgtgaccgttgctgaaaacttgtgccccctctgtggtatgcccctgccctgttctataaatagctataaattatcatatatatacacatacacaaactcacacacacacacacatatatatatatacacatatacatgtggtcgactgcctcgcctctagcactgggaatcagtccccgtgctgtgcttgtggagtcttgtagcccagcaagaggaagctgtctcctgacatcgcccctccaaagtgcaccacctccagtgagcttccgggacatgcgcggcctatggacagccagcccccgccatccctcccgcccttctggccaagcatggcggtgctgtgcaggcagctgtgtggcctgacagtctctaccagtcctgctgtccctcggctgagaaacccatttctgaatgacagagaatgtgtcctctgctggctgtgttctctatagagctcaggggagggaagaggccaagccatttttagggtgctgttggcagcagtgaaaaggtcacacccttttcaagggacacttttcctggaaagtccctggagcttagctggctcttattctgtgaagccggctctggccagtagggcacagggccctgaactcagcctggaaggagcctgtggggcagccggcactctggagggacagacaggccacccggtgcagacaggagagggaggcagggggacggaatggaagacacgtggggtggatggaagtcagtgcccttgggcactggtatctgtcttcctgaccacagctagatcaggcttctcaacctgttggctctcagggccggactatactccagaggcgccatggcagtcctcgtgaaatccaccaggtatcaccaggcagcatacaggtaacaggcctggaagattccccacagcccagctggacatgctgagacactctggggctcctcattgagtgggaaaaactgcaggacccagtgagggaaacaggaacatgccaggccgagcagtatggctaaatccatttattccaaaatcaaaagcgaaccaaaacaaaaacaaaaaaacaaaacaaaacaaaaaaggggtcccatcaccagggagccatgacgccatccccacccccatcatcgctcctatgctaacaatgaataagtttcccagccgcgaataattataagaacctcttcctcatatgccagctgcaacctccgctaggtacaatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggtcttgtcttgctaccctaatggtaaagggctgactggggaggggttgtagggacatggtgggggtgaagactccagacccacttctccaggcttatgctgacaggggcctgcttttatttatttttatttttatcccatgactttttttaaatcctgtaactaatttttcataactttttaaaataacttttcataaaactttttttttactttttttccacaacttttttttgccacttttccacagtatttttttatcctgtaactttttcatcccacaactttaattcctgttaacttttttagtttgtgttcttttaataaacacacttacatagttacaattttgtaagaataaaaaccgattacctcatgccaagcatgccgagaatttgcagagtctcaatacccaatactatagttttcaagacacacaaaatttttaggcaaaacagcaccttgaaacaatttaataatgtattacattacagtagcatcacagcagcagtcaataatgccactttagacaaaaatcagtatttccattatgcattctgtgtataagaattcataaatcggtaaaagtcattctaagaaaacttggcaaatacagctttggactggaattggcatttctttgtctacttttccttcccctagattctttgttttaaactacagtattcatattttaaaatgttttaaattattttaagacgttaatatagcagttacatttttgaatagttatttgaaagtgactgtaagataaagttttagagaatctattatggatagggttgatttacattttcacattttctaaaaatcagctttggttttagaactgattgtttttcattttgggaaaacctaccaggtttaatcaattactttaaaaataattatcatattttgcagtctttaaataggtgttttgattctttactccctacagaaattcaaatttattcagttgaagtcacattttaaaattctatgttcctgctgaactctaaccttctaatgttgccttctaagcaaattaaaggctgccttatactgaatgaggtagagaacaaatacttggctgaatgaggtactgcaaaagactgcatgcactttgaagaaagacttgagttattgtcataggatttccattctctttagctttttcttaaacatatgacaaaatacctacacaaagagtcgtatttgaattaatatagtatatttatttttcagactgacattcatcttaaatatgccagtatgtgatttaatccacaggtacctgatgaacacattattgtcagattggttacagttgctaaacgctatctgaaggtcattcctagtcatttatacgtgtcagggtaaaagtgaagcgatttgaactataaaaatacctttgaaataatttatcaatgtattagataagctcagtttcagaatgataaacaaaaactgttagaccaaataacttggctaattaacagtggtacgatttctagcccgagggtttaaaatggagttaaagtaagtgtctttaaactgaactcaaagaatgcaaaagcggcaagttcagacaaggcaagaacaggacctttagtccattttaagccataaatattacacaaaatatgcctctaactgaaactgagaggtataaaaacatatttcactcttcgtaaagaactttgtgaggaaatataactctgtgattgtatagacactttcctcatgacactttgacagtcacaaacagtagattgcgctgcagtttgtaaacattttacgttgcataaactgctccttgattttcaaatgtagtataatactgtctactaaaactcctttttgtttcaactaagtactctcacatatattagtttataataatgtttgttattatttttaaagtgttctccattcaaggaaaagaagtaaattcctatgtcagatggttgaagactagctattagccagagaggtctagatggtaaaatccatcttctagcctcaaataagctccatgaacacagaggaatgccaggtgtcacacagctttccttcactcgaattcattcttgactagagcctgtatatgcctgttccaggggcatttaaactcttaaaggatttcttctgatctttactaaatacattaaggagaacgccaaccagtgcccttttgtgtactgggacatgtagtcatgtgattaaaacagggaacatgaactctgactttaaaatgtattgtagatataaatgctctcagctagaaaaggttttccacatccacagtcatgatgggagcctttcattcctcagaaataatcccttttcaggtcatcaaaaaagagtacaactgccacagctcatgaggcagtatcttcatgagcccagagcacatacaaatcctaagggaactaccgtagtacagcgctcattcttggcaccggaacaaatgaaacatattctatcctgcacacacctgccaaagcaggccactttcctcttctgggagatttaaaaacctccccaaaatgttattactcccatccccaatacacagaaaaagggggaaaggctgtttccagtgctccacctttaaacaactgtaaatgtcagtactcacagtggcatattacaaagtaatagaccgcgcacttgagggcaaaccacatattgagctaatgaagagctcactgtgattaggattcgatcaaacataacagcagaacataaggaaattttatctgaattccgtaatgaatatacaggctgtactaacattaaaaaagcatggcagcctatcccaaaccagcaagaacagttgtgtgcatacagtgggtctttgtgtgtttgaactcccaccacataagggcaaactcgatatgcatgctaacgtcctataattatcaaattaaaaaaatgctaaaagatgccagagtgaacatgagagaaagacccactctcatttaactttttacaaataaatttaaattataaattagaaacacaaataaatttaaactataaattagaaacacaaataaatttaaattataaattagaaacacaaatttaaactataaattagaaacacaaataaacataagtggctctaacattcaaatgaagtaaatgaattgtgtaggatattaaccccttaaatgttttgttttttttttttttcaatttcttgacccgctcttagatgatggtgatgtttagctccctgttctccgcagcccgaaaagaatggcatgcagcctcttctgctcctcctgccgcctctcctgtaccaacagcttctccactcaagcctgggtgctcctggggagtcctgcattagaggaagcagctgctggatctgctgtgcagtggggttgtcatgggggagaaccctccctgtcctctcccggtgcagcctccatgctatcagtgaggctcagctcactaagatcttcagagagagggagggggtgggaatctgggcacagtgcgagcctcccctgctcctgcctgcccaccccgcctgagggctctactcaccaccctgcttgtccgcacatccaagctccttgtgggactggggctccaggtactggtctggctgctgctgcagactcggagcctcttggctcttcagctccacctgccggaagaccctgggcatgaggacatgtggtggctggcttccagattcctggcccattaatagggtagcgagggcactgtggggctctgtggcctgcccaggcccctggccccttgctccaggcctaagagactgtctcccttgcctagaaccccatgcctccttccctagcatcaaatctcacgtcctttttcccagcatgtaaactgtaggccacagactggtggaaaagcaggcggagccaaccaccatctgctaagtgtgctacatgcctaatgtttccacgtattatctcatttaatcctcagcacctctgcaaggaaaaggctaacttccttttgaagttaaagaaacagagacttagagatgcaaagtagttgaattatgaccagtggaaccgaggccggaatccagtttgaatctaaggagtcttttttgtttttctgttttgttttgttttgagagagtgtcactctgtgtcccaggctgcagtgcagtggtgcaatctcagctcactgcaaccttcatctcccgggctcaagtgattctcgtgtctcagcctcctgagtagctgggattacaggcatgcaccaccaggcccggctaattattattattatttttaattttagtagagatgagctttcaccatgttggccatgttggtctcaaactcctgacctcaagtgattgtcctgcctcagcctcccaaagtgctgggattgcaggcgtgagccaccacacccgacataaggagcctcttataccactgtctcttcctctgtgattggggggctccatgcctctagctgggatgatgatgatgtccagacctgggagggccccagggctacccacctctaaaagtcagagggcaggaagcaagaaacagtcataggactgccccggagggtgctggggtcacctgtccccaggctgcagctgcctgtggcctggcacctcccctccccagaggctggtgcccgcctcccacatcttcttggatgggtcagaggttacagtctctttcagctcacccgacttctccagctcctttacttgctgctccaactgcagtgtgctcttgttctcgttgttctggacagagagaagcaatcagtggccacccactaaaactggagaccccagaacttagtgtctgcctcccatggcaccgggaagggtggaggcaggttagaaaaatatcccctctctcccacagccatcagagcggggctctggctcacagatgcctttagaagtaccatttcatgtgaaggctacaatgccccattttacaggtggggaaacaaaggccttgagggctagggaagagggcagcctccccaggtggggcaacgtaccagctcctcgaagccgctgcgtggctcggcccgctgctcgtacagggcttcccaccccagctccagcatcctctccagctcccgcagcctctccagctcccgcagcctctccagctcccgcagagtctcctgctgccacagcctctcatcctgttgccgaagcctctcctgctccaggagctcctccacctcgtccagcagcctctccctctccagcagcctctcctgctcctcctgccgcctctcctgttctaacagcttctccacctcttccagcagcctctcctgccctggcagcttctcctgttcacacagcctctcctcctgttcacatagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcatgtagcctctcctcctgttcatgtagcctctcctcctgttcacgtagcctctcctcctgttcacgtagcctctcctcctgttcacgtagcctctcctcctgttcacacagcctctcctcctgttcacgtagcctctcctcctgttcacacagcctctcctcctgttcatgtagcctctcctcctgttcatgtagcctctcctcctgttcacgtagcctctcctcctgtctcctgttcaggagactcaacatctgattgttttccacctcagcctggagctgtcttcccacactctctagctccttccttaggtggttggtctcatcttgtagctgctccaccttagatggccctgctgggggctctggggccaggggttcagctgagaaagcaagcagagaataagggcctctggattctcaaaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccgagactcacatccccaggtgagtggtaaccaccagaagtggctgtgtcagggctactgccattgactttctttttcctgttagctcctgctggaatgccagggctcttcctctgccaatatgcttttaactgtgggaaagaagagcagtaacactcatgagaatgatcagcccctacagccacatcctcctttacagttttgacaaaatacccttatataccatctgatgtaatgccaccaacaaccgtacaaggtgttgtcacaatcagtgactgagagggattcatatcatggatagaaaaaaaaaaaaaagaaagatcaaaaaaggcaatactggaacttaaactcagtcctctgactccacgctctggggttttgccatgaatcagcagcttccagggaccaaaaccaggggcagaggtagaaaagcacacattaagcaggcaggaactgtaggccgtgtggtttagagtcatacatcctcacaggtctgctagcgtgaagaagcgtaccagtacctctcacactttcatatcaatgtgtcctcatggcagaaggcagcttttctattaaatctgggaatttatcagaaagaggacaacccaagcctcatttcagagcaaagtctggtatacgcttggaaacctatgtgtctgtcacccccaagtacattaatgcattttctcaagagaatcaagggaaaatgatgcttcagaaagatgtcccgcatttatcctgtggcactcaaagtaccccaggttgagacgatatgaggaagattcaagctgtcaagttcagtttcccaagatctattccacagaagatgagcaaatctcacttcagaggccactgactgaagggcagtctggtcccagaaccgtggagaactcagaaaaaaatgttaaagtctctctggaaagtagaagcctgggaaaaaaccaaaccaaacccattctcccattgccacccagagatactgtgaacattttgagctcacaggggaagtgtaggcttttcccactgtcaatgtctatgttaagggagtaaggcagcctgaaacctcttgctcctaggtcccatagtctccactccccttccagctggaaatttgtgctgcaaccagaggaaccagaaatggggtgagaaaacttaggggactgggttgtaagatcaaaggctggtcttgcagcagtaatgacagttcctaggggcactgtgacatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgttgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaacttacagttagtatatgagagcagttctcaaaaatgtagtctctggactagcagctccagcagcacctgggaacttcttataaatacacatcctccggccccaccctggacctgatgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagattttgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtaagcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattgacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaagcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaagacggaacgactgtggtgatcgagtagccaaaagttcacggaatgcactgtcacaattgtgattccgccatagcgccgtgcatccatccaacacttgtttaatacctatatttaatacctaataccttagagtgtcctaggctgtggacacacaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgctccgcgtgtactcacgggaggactcgcagacgttactgccttcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcgggatgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacatttttttttttttttttgcaaaggcaaaccggtatgtgaagttgaaaaaatcaaaaaccctcaaattttccttcttttttttttttttttttttaaatcaagaaagggggtagataggtttgttttgttttagaaatagtttttatagcagagtgataccgtcacatttaatgatcctactgtgaattcaagaattcacgatgaaagttggattgagcggtattttggtgttcattctttgctgatactcattaatgaagttcgttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggatttctaaccttttttttaatctgtcggttattttttgaaaagaagtggggcttaactagtgctctaaggattttaacaagagattccgatttagaaatctgtccccccttttggtgaaattcttattttttttagagtcagaatcttcactgttgcccagttgtctccccgggacccaagccgtcttcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcatttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctccgacttgtttaaggtagaactggactgggtgttaacagtgttagttcagtagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacacggacacagggaggggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagtaaacctttgaacttaacagattgagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaattttttatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcactgccatgcctggctaatttttttatttttgtagagacagggtctctctatgttgcccagcctggtctcaaactcccgggatgaagcaatcctcccaccatggtctcccaaagtgtagggcttacaggcgtgagagcctgctggggtttttgattgacattgcattgaaactggaaatcagttaggaggcaactgacattttaataatgagccatgaacatggtatatctatttatttagaccttcttagatttttcgtcagtgttttgtagtttttagcagttggatcttgcttgtattttgtaatcttacacatttatttcatgtttgtggtactgttgtgaatgatacttctcaatttccagttggtgattgctagtatataggaaggtgattttatgttatatgctgaccttggattctacaaccttgctaaactcatttttagtactagaagcttttttgtagatttttggaattttgtgcatagacagtaatgtcactggcaaataagggcagtttaatttctttgttttcactttgtatgcttttatttccttttttttttttgagacggagtttctctcttgttgcccagtaaattagcccatgtaaatatttctgtttgtatctcttgaaagtaaagactcttttaaccatggatgagtgtcttgatcaaatcaacatggcttgttcatgtcgataccatttgctcagaggggaaagattaagggaaaaatggggttggatttcaaatgccaggacctgtctactgggtttgtgatttgttattctctaaagttgtagctcttaaaacaaagaaaggagtgagtttggcctattcattaacttttactctttagacagttcaaatgtttattgagttcttctacaggccgagccctgccttcttcatgcttaccaagaagcatttttacgcggtttctctaatgtttgggtggacggtacctcactaagttgtttttcacgcacgtgcgtgctcgttcctgaagagtcctgtccaggtgccctgcccgcttttcctttcaggcttctgtatcagctgccgtttccctatagaacgtgccctgacctccaccccttaaccctaaccaatttgcctttacatgtctgaccatccatcaaggctcttttgggtcatattcagtccatgttgatatttccccttcctcccttctttagtccttactatttttgctttggtcatgttttcttacactgtattctgtaagcctgtttaatttttttatggtggcaggggaaaatatttcataattatgctttgtgctttttatcttccactcaataaatgcttggtaaatatttgttttattgaatgtatgagcctattctagctatattgtgcttgaacaaaaatcttaactgccttgtaagttaactgctaagaatttgtcaaaagtgcagagataacatcaagagcttgtcatggatagtacaaaaaggtctctaagggcttgatggaagtctgtaaattgacttcctatgaaagagagtgtaagaagtgaaaaaaagcaaaacagagtagatgttttactctgtttgccaagggatttgtgctatttttttcctgttttataaatttgccctaatcttaaataatgaagggaaaagagcactctttttcaaccaaggaatcctttttatacttcttttctgtgaagccatgttatgaaagattgttatacaaacttaagtatagtttttccatcttcagtaacagacctgattgccatctagttactggttctgatcacacaagaatgcaaagcagcttgttctaataacttgtgcaggcctattgggaactagtatatggctttgagtccttttgaagtatttaacataatttggcaattccattactccttttatggacttcttggcatctatgaactcttggtagggaatcactgttttagaatgaaaaatgtctcccaggaagtaaattagccggtaaacaaatgaaacttcattttttatatgacttgtagagcataaattattactctttctgcataagtggctgctttctaggctgcttttagcgagattgttagaaacaaatgatcggtgctgtgaggaagaagcagcactcaggcaaaaaagttttctcagcaagacaatttgcttctgcaagtatgctgcttgcattagtcatgattgcaagagcacaccaaacggggtggagcaggggttcttatccctaatgcactccctacctctgtgtcattccaacatgggctggggtaggactgcacaatcttagctgactcagctggatattgtgaatattttctctaataagaaagggagggggaatgtgagttacaggttgggactggtaggaagagttgtttacaaggcaggttactaagcaggtaactaagctggtaagtagggtcgagaaggtacagggaaattgttcttaggaacaaagaacaaggaagttgaacaagttaaacctttgaagaggaacttactgtacctaacaattcccccctcttaatttttgtaattcttcctcttcaaacttttttagcatgtctttgctttgctgttctgcttggttttctagaaggaaaagcttatctgaatagggtggaggagagctaagagaagttttggtaaattctgtgtctatgagtctttgcagtagtccacaaatgtatggtatgatacagcatccaacaagaataagcacacctataacgattgcaagagaagtaaatattgaggacattaagcctttccattttccagaccatttctccattaaacttgtaaagggatcatttattccagaattgcttgctaactcattggataaggaggttaggtcctgcaaagcttttgttactgttccgtcaggggctgtgttattaggaataaaagtacatcattggactccaatcaagacacagacaccacctttttctgctagcatcgtatctagggctatcctgttttcccagactatttagttaatgggacctaattgggaggctgttcccttaatggcatgtcttgtgtagttaacaaacctttgttggttgtaataaatgtagtttatccaatctacatttttatttacagttgaccaccaaaacagcacagattcaaatcctgaagctgtttgatttcgggccttaaatttatctggtacccctcgtggaactccagtagcatctttataaacgtgggagtcaaaggacccatgaaggtcacttcttctcttctgattttctcttctattatgttaatggaatgctagggtgaaagggatggccagttggactagagcacaagtaccactccagttacttggcagagtgtccagtaagggtccaccacaataccaccatacgtatgctcgaggatgaacaagggcagactgactggtaagctcttgggagagtttaagttcaccgcatccctttaggtcttcatgaaatgccaagttttccccttgttgtgagagacccgaggtaaaaattggtgtcaatagatggaggctggatggccctcagggactgacctgcagggtgttggactttagggaatagcagagagagagcttggcaagattcattaccccaggctgtggggtcttggagaagagctaccatacagctcatgcccagttggctggaagaccatccgagtggaaaggggacaacctgggcctctggcctactgtgcgcacaagtgtaacagttgcttttgtttagagtgcggacagaatatttaatccattctaaccaagcatttgcatcttggtaccctgtctcagttgctatggtttgtttcaaatttttaacttctacaatggcttaccttgattttatccttggttgaaggaagaacagcggtttcgttgagagagagtgtagaaggaggtggaggaggtgagaaagtaatgaaatgcatttcaaaggattctataagatgtgtccctgctattttggctcctatgccgtataagcgacttaaagtaggtttagggttggcagaagtggggataagaatagaaatttgcactggattacattggttatactggcagtcagggggtggggaatgtttcctttaacaaagcaaacatggttttagagacttacaactgcctgttgacaaagccctgatgttcagttgtccacataatatcattccagctgtggcaggcctgtttccctacatttcttaaggaacaagagtcgtaatgggggaggcttttgtctgaaagggacggagatacttctctgaggctgagagttgcttttgactttggagatctccacaggatataacaaggcaagcatcaaaggtaatagtttggggtgagctcgacctagttacattaataacgagaggactagcaatagaaggggaaaagaaatatagcataagaggatcaaacccgttttagctttaacttggttggaattggccctgaaatagctgtccatgattctggagtgggtggtgctcttttgactcaggtatggtgagtccattctttttcagtggtgtggacggctgtctcagtcattagaaacactagataatgtccctcccaggtgggcttgagcttcctttctttctgacctttgatgagaatgtggtcactgtccgggctggtggtggtgaactggaaattcaaggggtggtgtatgtgccaagaggcctttagtcctaaggaaagagaaagtggaggatagaccaagtatatagttcttgagaaacagatcttttgtttcgaacgaggaatgtcagcagtggagtgtagataaggcaactcatacagcatttcataaggaggtgagccgacatctttcctaggggcagtttggaatcttcacaagaccatggggaggcatttagtccatggcaaccgagtctctaggactaatttggttaggtggtttttcagagtctgattcattctttctactcttcctgatgaaggtgggtgccaggggttatggtagtcccatgttatatctagtacttgggctagtttcttaagaacatgtgcagtgaaatgagtcctattgtctgaatcagcattttctattaatccaaacctgggtataatattttcaactaatgccttgagtacattactagcagttgcacttgaaaagggaatagcttctacccaatgagtaaggtgatctatcactaataaatattttaagtgaccaattgggggcatttcagcataatcaatttggacactttggaacagccttaatcctggatttctccctccaacaggtggttttctgaggatctgcttattagtcttcttacatactaggcaactatctgtaacttgtcttgccaaaatataaattcctatacatctgtagaccccgaggactgcatcacacttagcttgaggtccctaatgagtcccttgatgcagatgggagagaatttccctcatgaggggtttggataacatttctctttggtctggtgacacccatttcccttctgaattttctttggctcctatttttattaatttttccttttcagcgggagaaaagatggggactgcagtcgagggaggaaggcaagggactaagtgaaaaacaggcattttcagaggaaacggcagtgtgtttggctatttgatctgctaggttattccttccgctttgaaaagaaagacttttctgatgtcctggaacatggacaatagctattctggcagctgcaggttatctaatacttgggtgattaattctttgtggcccaggtcttggcctttgctattaataagatctcgttcagtccaaatttttccaaaggtgtgagctaccccaaaggcatacttggaatcagtataaatagtccgttcttggttttgcaagtgctttaaggcttgatttaatgcaaacaattcattcacatgtttgggcagaccaattatttggcaggcttcctgactctacttcttcaagtgcctccccatctactactgagtacctattacgcctttttccttcaattacttgggaagagccatctataaagaagccctgccccgttttgtaaggggtctctcttaaatcaggcctaacttttgtatgatcattaaatctaaacactcatgctcaggtctctttagatttggatctccagtcaggaaacctctgggttaagtgaattatcagtggttagtgttaaatcatctctttctaacaggatagcttcatactttaaaattctcaagtcagtaagccaccttcctgccttttaatttaagatggctctaacctgatggggcatgtttacaactaactttcccccaaaggttagttttctgctttctttagttaacaaggcggtagctgcaatggattgaaacattcaggccatccacaggttactggatctaaaacttttgataggagatccatgggttgctggtgacctccgtgttcttgggtaaggacccctaaagctacccccttatttatgttaacagaaaggtgaaatggcttttctagggaaggcaaagctaaaacagaggcagttataagcagatgttttagctcctcaacctggtggagttcttcagaagtccagaggagagggtcaggcttttcttgggtgatttttaggtagagaggctttatgacaagggcatatgagtcaatccataagcggcaatatccggctatccctaggaattttctgagttcttgtttagtcttaagcaaaggtatggatacaatcctttcaaccctctcaggccctatccttcgtttgccgttacttattaagtgtcctaggtatttaacttcaggctctatgaatcgaagctttctctttgaaacccatagcccctctccttacaaatggttaaggatatggacggagaaagcagataccttttctatagcctaaccggatattaataagtcatctacgtactggagcagacatatacattttggggtataaacttgttctaacacttgttctagaatttgaccaaagagattaggggaatctgtgaagccctggggtagaactgtctatcgatactgttgctgtcatccagaatggggatcttcccattcgaaagcaaaaatgtctcagctgtcctcatccaaggagcatgctcaaaaggcatcttttaaacctattactgtaaaccattgatgttcatatggaattttactgagaatggtttaaggattagggacaacaggatgggtagtctagactgtctggttgatggcccagaggtcttatgctagtcgacatgacctatctggtttcttcacaggcagtattggggtgttataaggggacatacagggttcaaggagcccatccttgatgaggctttcaattacaggtttcaggcctattctgccttctaaaggaatagaatattgctttcttcttactatttctccaggggtttttaactttatatgtatagggggaatttggagttttccccaatttccttcccttgcccaaacatcaggatgaatgtatgtttcttctgcagtggtgagcaggtttaatgaagtgtagaatccttctgagccaatacgtaaacctatacctaattttaacattaagtttcttcctaatagattagttcctgcctctgaaattaacaaaaattcaacattagctgagcagtttttacatctaatttctgtttcttttaaaatttttagtttgattccctctccttttacccctgagactacaagctcctctgaggaccaggttatattgtgggggaaggtaacaaacagaggagcaggctgctcctgagtctactaaaaaggtcataagctcggatttgggttccacttctaaatttatcaagggctcttggtgggattcaaggtaaaagagacagagcccctaacccccctattcctcctcaaaggtcgtaagtgggacgacttctctttctgattttaatttgggacaatacctcttgaagtggcctactttctcacaattgaagcattgattctgtctcttctctctatttttgggtttctcggctttgtctccttatgttctttatatggcttaggaagtgggggcctaggatctttataggttttggctctcgggaggctttgtttgggagtgtgtgggtctctgggtaacagagagtaatactggtgtgttttatcctttggggccccctgttggaaggtggataacataattttcattttttctttttgcttctcctcatccctccttacacacactttctgagcttctctaagaagctcgttcgtgggatggtccttccaatttcctatcttttgtaatttccttgtgatatctggctgttagtaacaaaatgaagctttaacattcactgcctaagaggatcttctaaatctaggccagcatattttctcatttgttctttcaacctgtctaaaagttcgataggcccttcatctttcctttgttgtatgtcgaatgctcgagtaagattttgggttcggagtactgactcccgaatcccttttattatcatttccctaagttcttgcgtatcctcttcagtgggctgcgttattattgtcccagcaggggtcttggttggggaatttttgatccgctgcatgaatgttttggccaggagggtgttcatgttcccagggtaccatagcagctctacagatgatgcttctttcttcccctgagaaaaggatgcctaggatggacattaactcagcccaagtatatataactgtggtcctagaaattggttaattcgatctgctattccactggagttgtctaatagtgtggcttgaactctgtttttaggttttggacctccgagctggttaaaggagcatttacaaagtgaatacctcctcctcgtagggacacctctcttcaggggaagagaggtggagctaattctcccgaggtagaggggaaggggaagttctgaatatcccttttacattgctctatctcacactgaagtcctttcagggaagagtacttagggtgatagtgagcaggctgttgggacaattcccaagaggcagggttataaagagggggaacaatgtgggtaggagaagggtctgggacaactgcctctgcttgagggggaaggaggttagggatattggacgggggaaggtggtggaggaagttccatgtgttggtgagctgtctaggaacagggaccttatctttctcagaggagttaatttctgacttgcttttcaggattgattcctgagtccaaatgaaacaacaatattttatcatttgctgctttttcttgtatttagtcctttcactctcttttcaatattttagcataagccctaggggactatcaggaggaatgttattgttgctagctttatcctttttctcccctgcattacttgaggtatttcccatcttgaaaagggattggggtgaggctcaatttcccctactagaaatttcttcccagttacgagaggtttgtataaggctcaacctctcctactggagatttctcacctttcctttccttcccttcccttcccttcccttcccttcccttccctttcccttctctttcccttccctttcccttccctttccctttcctttcctttccctttcctttcctttccctttcctttcctttccctttcctttcctttccctttccctttccctttcctttccctttcctttccgaggctcaacccccctgctggaggtttcttgcacttttctcctttcgcttcatccttctctggctgcttccctcatgggaacgttggtttcctcttagcaatggctgtttcagtagaaacccctgacccagactcctttacagaagggctaccttaagctgtataaggtgaccacagaactgcagatctggactgaacacttgctttgcactcaattgtgagtctcaacacacactttcaatctccaagatatcccaaccaccaagaaaatagtttgtcgctcttgtgatgtttcttacgttggtctgtgcacatagttacctggtcaccatggtatgtgaggatccttttctcttaagttgttggtctgttcctttccagactgctgagagtccgggtttattcatcacactgggtgggtcctgatccctcaccatgaggccacctcagtgaggcagtgggatgcttctcctcactattggtgactggagacccttttctcagaggagaatgggaattccagacgagcccccagattgttagaaacaaatgatcaggctgggcacagtggctcgcccctgtaatcccagcactttgggaggccgaggtgggcggatcatgaagtcaggagatcgagaccatcctggctaacatggtgaaatgccgtctctactaaaaaaaaaaaaaaaacacaaaaaaattagctgggcgcaatggtgggtgcctgtagtcccagctactcaggaggctgaggcaggagaatggcgtgaacctgggaggtggagcttgcagtgagctgagatcaagccactgtgctccaccctgggcaacagagcgaaactctgtctcaaaaaaaaaaaaaagaaagaaaaaagaaacaaatgatcagtgctgcaaggaagaaccagcactcaggaaaaaaagttttctcagcaagacaacttacttctgcaaaagactgctgtttgcattagtcacgaatgcaagagcacaccgagcaggatagagcaggagtttatatccctaacgcagtccctacctctctgtcatttccacatgggctggagtcggactacacaatctaagcagacttgatttgctatcgcgaatattctccctaataaggaagggagagggaatgtgagttacaggttgggactgacgggaagagttgtttacaaggcaggtaactgagcagataactaagcaggtaaataggggtgagaaggtacagggaaattgttcttaggaacaaagaacgaggaagttgaacaggttaaacctttgaagaggaacttactgtacctaataagtttttttgattggctaattaaatgtctattcattattgccaaaaagtgcctacctcaacaacaagataccaaattttagaaaatgttggagctctctctgaatctaggaggaagtgagtagtttagcttttatttagtagttaggaccttaagtaaatcactttttttactgtgtttctgtataacatagataatattttttgccctgcaagagagcatatagaggaaagctctttggcagcgatactgtgccctatgaataaaaaagtgatggtgtcatttgtggctgaataacagtttattttgagaatgctttataacagcttttcatgggaaataaagcaatgctgttaacttcatcttgcatttttctcatttttactatgattaaaaagtagtcagcttgtacaaaggaaagaaacaagccttgactcaggagcctaggactttttctttggtttgccctcctggaacagattacctttccaaattgaatttgtggaggagcattgggaaatatcagaaatgtcatattaagcacctcagtggtacttttaatagaggagttattcagaaattatactaggcagatagagagggtaaggaggcctcagtaaggctttcccttttaatagaaacaactccagaaacatttctttttcttttctttttatcttttttttggagacggaatctcgctctgtcacccaggctggagtgcagtggtgtgatctcagctcactgcagcctctgcctcccaggttcaagtgaatctcctgcctcagcctcctgagtagctgggactacaggctgccaagctttgatatgcaaatgccagcgcttagaaactgtgtccattcaacatggagattcccaccctcttcttctagtcaccacctcaaggtgacacctccagatgaccccatgtgtgcaggacaacatggtgacctacatttgcatattaaaaggctagggtgggagggccacgtttttctcgggctacatgaatgacctgcctggtcaaaccaatgccctgggccctgtgcaaatcagacaccacctcctccagcctcccaatataaccgagtactgttctgccacacacggggctttttctctgttcagacccccctttttctgtaccgcagggagcctttcttctttcttgcctattaaactttctgttccttaaaaccactcctgtgtgtccatgtcgtttaactggcgtgagacaaaggaccccgatgtttctcccgttttcagagccatatcactttgagtccagaggaattattttcatttatctgaccaatttataatatagggtcaaattcctagtggttatcctccctcatccccatttttatacccttccttgaaaggaacaggtatatgaagaggagacaggtttcccttttgtgaatagtatatcccttagtatcttgatttttttttggtgggggtggggggagttaaacttacttagacctggtaaagggcagtatttgataaatgtcagctagtttagggttagggaattgagttgaatggagatagtcactgccaaatgtaaagcatgactggagagccacagtgatgaagccagggtccctttctccagatcctttgtaacagtgttatgtgatctcttctagaagattgttctgaaagataatgccaactcggaacctaggaaaccatccagtgggtttctgcagcttaggtggttcaaatcctcatcagcacgtttgttttctctgcctcagtttgcttacagtgatgttctcagtagctgtaattgctgtctttgaatacttaagcattttttttttagctcacaggggtatgtgtgcatttttcttttaccaagtgttagaactttgactctgcttttgtgggctctggtttagcaacttggttgtttagttgtaaaatgattagtagggaaaaccgtgtgtgtgtgtgtgtgtgtgtgtgtgtgtgtgtgtgtgtgtattttaagtttcttttgttctcagagcacttagaattttatatggaaattctatcagtttacttgattctccaccccacatttcttaaacagcaaagtatgaaggtaatgtgtcccgtaaccagccttcagaataattacagctgctgtgtctctgaactttcaagaagtttgtgcatcaattttcaaaaaattatgaaatccttgaagatagctgtgttctacatttggaaagatacaaaaactgaaccttctagcaggcagttttgcttgctggtgcttgcgatagagccacacattggtctcagtggatttatggagaaaaataggtacggaaagttatttctaaataagaccaaaaatccttttcttaagcagtgacaggtaaagaggttgtcttggctaatattgaattgtgttgcccttgattgagacagttttatggtggggatggtagtggtgataaacttgtttgaaatttgtccacctatagtaacctttgtggtagctgtcacagacagcttcatcctcacaggccctaaaattactataaaactaatagattggaggagaaacaaaggacctgaataattagatgcttagataattgttctgtgttttcataacaagtgaaaaagagcagtgttagaagtacttaaactttccatgtaaggagcactgcctgaatttatattgtgattttagagcatcattcactgtttaaaaacaggcatattgtgggtcatattttaaagacaaacagaaagcttatcttttcaagatggatctaaagcttaaccttatcaaaattacaaaatgtgaaggatatgattgaaaaatattaatgcataggtttaaatattggtcatcattttagatgtctttcaaaataggttgtctcttaaatattaaactgaacaaacattgaacttgttgtagagtttgtgctcaaggttaagtttcctggggtgatggatatttgataatatggataacaaaaagttcttaagaaatttagaaaatttttaggcaaaactagaaaataatactgataattctaccactcagaatgtaccactatcagaattttgtatctttcagtcatctgctcatctcttttctcctttgcttgtatgtgttccctctcccttaaaaaatcagattttttttttgtaatctgcattttcactcaatattgtagatctgtgtcataagttactcctctacagtgccttcagttattgtgtgctttgtgttggatgactgtaccatctagtctttcgtgtttcctggtactgactacataggggtgagtgtgtgtgtgtgtgtgtgtgtgtgtgtgtgtgtattttttttctaccttaactaatgctttggacatcatcaacaggtagagctaaatccttgaaaccttccaagtggtggctttcagttattgctgaattggtttttagagatggaacaaattatattgtatggaaacttttttttttttttttttttttgagacaaagtctcagcttgtcacccaggctggagggcaatggcatgatcttggctcactaaaacctccacctcccaggttcaagtgatcctcttgcctcagcctcccgagtagttgggattacaggggcctgccaccatgcccggctaatgtttgtgtttttactagagatggggtttcatcatgttggccaggcttgtctcgaactcctgacctcaggtgatccactcaccttggtctcccaaagtactgggattacaggcatgagccaccatacccagcctttttttcttctaggtaccagcttttatttatcagattggtataaatgttagaaagcgtgcaatgaaatgggcattttcacagtcgtggcagaaagtataattatctttgactttctagaaagcagtctggcattctagaaacttgcctaacctcttcccatttagacaagatgaattctgacagggccagccttgtccctgtgattccgtatctcccagaaagagaggtctagtctcagggaaaacccagattttcttggcttagcccacctgacagctaatcactggaaatggggcgggccggtagagtcctttggtcaggttttgtgtcaagagagggatgtggaaagatgggagagaggtagcaaaactggcctcaatggaactgtgtaagttaacatagaatggcaaaggaatgtttcttccaaggaagaaattctagggaaggaataaagtagaggggaaggcagcagttctcaaagttttggggtcaggattcctttacactcttaaaagtatattgagggcccaaggagcttttgtgtatgtgggttatatctattggtatttatcactagaaattaaatcagaaatacttaaaatattccttaaaagctcacaaaatattgttataaatgcttttatgataagaaaatttctaaacccaaggtagtacagtcttacatcttttgcaaatttctttgatgtttgatatgtcatttgtacctgcattcaatttattgtgtgatatttgcttgaaaaaatgtgaacaaaggacagtctcatacagataggcatttcagatcattgtggatatttcttttttctttctttctttcttttttttttttttttgagatggggtctttctctgtctcccaggctggaatgcagtgctatgatcacggctcactggagcctcattctctggggactcaggtgatcctcccacctcagcctctagagtagctgggactacaggtgtgtactaccccaccttgctaattttttgtattttttgtagagatagggttttgccataggtattcaaatagaaagttttgtttttgttttagtatataaagaaatataactttccatgttggaaaaatttttaaaacctttttttaattttaaaactcataagcaaccattgttgagaaaattggtaaagtacagaaaagataaaagaaaaaaattaaagtctcccataatttctctatctaatataaccactattgactgttgacatgatggtcattttctaccagtatatattttttctttgctattaaaatacataacccttacacatatgcttaatagttgaggtcatattctctatagttttatatatatatatatatatatattttttttttttttttttttttttttttgagacagagtcttgctctgtcacccaggctggagtgcagtgccgtggtctcggctcactgcaagctccacctcctgggttcccaccattctcctgcctcagcctccccagtagctgggactacaggcgcccgccaccattcccggctaattttttgtattttttagtagagatggggttccaccgtgttagccaggatggtctcgatctcctgacctcatggtctgcccaccttggcctcccaaagtgctgggattacaggcgtgagccactgtgcctggcccttttatattcttttaaaaagtatttactgtattttcctgtgatgtcatagtctttatagaaaaataatcattattttcagttgacatgattgtttacctaaaaatatccaaaggaaccaactgagaaaaaacaatttttaagattactggttaaaagttcttttatataaaaatcaatagccttccccaatgttagctataatcacatagaagatatagtgatgaagtattttttcaggtatttcagcaaaaattaaatgcctaggaataaacttagatgtgcaggacttttatcaaggacaggacaaaattttgctgagtggaatgaaagatttgcattctatgttcctggatgagcagatttcatgttataaatatgttagttatcaccatgtcttcatattaatttgtaaatgtaatttctgctgggcacagtggctcatacctgtaatccaaacagtttgggaagctgaggcgggtagatgacaattagctgggtgtctgtggcacacacttgtatttccaactacttctgaggctgaggtgggaggagcacttgagcctgggaggcagaggttgcagtgagccgagatcatgcctctgaactccagcctaggtgacagagtgagaccctgtctcaaaaaaaaaaaaaaaaaaaaaaactagaaaagtgtgtgtgtatatatatatatttcatattttataaatatttatatatataaattgtatatatacattttatattttatatatagtgtgtgtgtattatatatatatacacacacacacaaatttcagtacaaattctggcagatttatttttgacacttgacaaaacgactctaaaatttgtttagaagaataagtaataaaaattaataaagtatagactctttcaaccagatagtaaataaaatattgtggactatccctgggccagacagataaaggcaatggaagtttagaaccagagtcatgcaaacgagaatttagtataaggaaaaggtggtattttaacttaatactgaaaagatagattattctgtaaatggttttaggagaactatttgaggaagtctgagtcttaactccaatttttgtcaaaataagttagttggtttaaacacatctattcttaaaaattagaacagaagaatattggtttgaagatattttaagagttaaggctgaggctgggcacagtggttcacgcctgtaatcccagcactttgcgaggccaaggtgggaggattgcttgagcccaggagtttgagatcagcctgggcaacatagcaagactctttctctctctctctctctcgatatagatatacatataaatatacgtatacaaatagaaaaaaaaaagagttaagttttatatggagagccatgaagataagaggtaaaaattaaaggcttgatggacacatgtttacatctccatcaagggggttgatgggaaagaatgatagacatagctccattactgctacctccttttaggaagttgcttctgaacatctaaagatatcagttttataatagaaatgagttatttttcagtgtctaaaacaccacatgagatacatacatacatgcatacatacataaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgtcccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgagtagtacaacacaattaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaatgaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatgggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtctgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgcggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggatgaccgcgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaaggctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcggacacacgcacacgccagattgtgcacacacatgctgtgaggccccacggcccgcatgcacactctaacacatgcccacaaacaacacgcatacgtcgccctctccgccacctcccggtgcccaacaccctcaccagccggcacgtgccgcatggatctggggcgtgcagccactcggcacactgaagcacatgcgtgggcagagtcacaacacagatgctcacccgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccaggctgccttgaagaagctctcccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacaccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcatgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacatgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctgggagcttcagttttcttatctgaaaaatgaggacacctgaccccttccctgcccagttcagtgttgtgggacagggttgctgtcaagacaatacccagtcctgccctcctccctgagtgggccaggtagcccatgtagcctcttcccagctttcctgggtggcactgcagcctggtgcccattcaatctagtccttcatcttgctggagcatggggaagctctgagtaacatgggactatagagtgcaagagggttgctgatggtctgggtcctgtgccctcctcattcctgggcattcttgacaaaggctcccagcaactgagggtacgcagcagctgtagacaccagcctgatgaatatctcattgtgggaagggcaccatagcaggagtggagctccagggaaatacagaaccgaggtctgggaggtgctgatgtgagaggcccaagaaacctcggctttgcacttgctgagtaccatctgcacctctcaggagggagagcgccaggctcaggaggtccttgccgaagcaagggagcttgaaaagggggctggggtgggctctgccattttcaagggctgacagggatcccctctggaggtacttggggcagtgctgtgtgccgtggctcctgagtgacagagtcagctctgcgccccacaagaccgctccctgccgagaactcactgtgatcatgtgctgggtccagatgctcacgcagcctcctgatgggagcatcaggtgtgctgcctgcccagggcggcccacaagagtctgccctgccctgccctgccctgctatggaacaactcccattctgcctttggggagaggtgttcatttaaaccatgagtgggctggcccccgtggcacagttaccacagagagtctgccactacccatggctgagagctctagttcttctctgaagccaccaggacagatgaacagtggcttcccccttttggccgactcagctgcctttcatcagctcatctgctcctaggatccactcttcctctggctggcacctgatctgagcccgaggctcacacctctgcccacaggccccagcagctgcttcacctccgactccatcccccaccaagcactgcccctcaccagctgctggggtgccactagtgcccctacatggttctccctctccagacccttgggtccagctctagcttccttcgggaagccacaccccaagaccccagccctgctctggggccctgtatccccgacttcctgcattcttctccctccttctgggaacatgaacttgccctgccagcctgatgactcctagagggcaggacaccaggtcctggaccatggcaggcctgggagtgtctgctgccggtgatgctggagctggtgcccatgtccacatgatgtccatggcacagtggccacctgaggctgggcgcatctgagtggtggctgcagagtggggcccttacctctgcctgagtgaagttcaccaggtcctcccctgtgctgtcatgctgggcgtggaagagccggcctagctggaggccccgcaccacatggtagagcaggagctgggggtcggtgcctgctggctctgaggctctggctgctgagtggctggacggactctgccagaggcaaaaggggccatcagcctttgtgatccaggccgaggcctgtggctgcagagaggcagtgtgaccctggcatgccaccctcagctctgccccagccccccgcacccaggaacgcccacaatcagcacacccacctgggcagtcagtgtccggctgccctccagcgagtgaagcacttgcttctgggccgtcactcagaagctaagtgtctggaggaagtatgttcaccgtcagagaggccaaagtggatgcctccgtccagggcccctggggacaagggtgttgggtccagctggcctgaactggctccccacctcagggtgcccccgtgggcagcagaaacctggggctcggccctcagcacccacctctgtgtgagaacagcacgagcccaccatccagctgggtctgcttgaagctgcgcacctcagtgcccggcaccgcccactgcactacccacccattgctgggctgcttaatggtgtacaccaggtccttgggcccagagtaaccatccatgctcctcagagcctctgtagggatgggcacggtggccccctcccacatctggggacacaggcctgtgaaggttctgccctgccacacttacccaccccttcctccccggccctgggctgccaccagggctccaaccccactgaggctcaggccctcaggtggcatcaaggctggcgctgctgtggctcccctgcacaaatggcctccctgcattcaccttccctgtcaccccagggaaggccaccctccaggcccagcatccctgctcttcatctgtcctagtcctgtgtgtccctcaagaccagcttgtgtacccaacccaggaaggccctagctcttaccgtcaccaagttctcacccccagaaacccccagcgctgaccaacagtgctccttaatctagctcactggtggggcagcagtctcctttcagaccctccatgtgtgcctggcaggggctgggcacaggtgggaacagtgattttagaaacgagcactccttccagctaagggaggggtgggaggcgcagagagctgaagcctgatggttggcactgtcctgcagcacagaagcagtgctgggatgggcccaggtgcttccagagcagttacgggccctcctcgtgttgggcaaagggggccccttttcaggcctcccactagcaagcagaacaggcacccgttcctgaggtcctggtaccactcttgctgggtcaattacttgtgggcagtgctgcagtgggactcacatgcccagaaaacagccctctggcattcctgggcttcctcccctggccgcagggagccctcaggccgagccttggcaagaggggccatactgtgggaggcagggccccatcactgggctcccggaacaaacacgggtagatggcaccacctggtggccgcactgccacacagccatcccagcctgtggttccagggtgctgtgtcccactcttctgtggcgtccgcaccatgaggccaccccctacaggcacatcctagaccaccaaagccccccggtgccccatgtcagagacagcccaagtcagccctcttgcggaaccttcagtggcttctgctgactggggaggacgcgccccagaagctggggttcaaagccctgccacgtgggcttagtaaagccatgccctttctgttccaccagaactacttttgcaatcatggagaagttccatcccatctctgggcctcaacttccacctttgccaaatgggggccctgctctgctgtggacaaggggcaggagtttgggaagccaagctgaggcctccacttgctggggtgaaggtgggaagcttaacggtcccaccctgacgccagcccttaagggcttgtaagtgattctttcaggtgttctggtcctaagccacaggagaaggaacagcagagccacccatggctgctcagaagtctgcctaccgtacttgcaaatgtccaataacaaaacctcccacctgtgttctatttcagcacaatctcacatctctccttccaacaactgcgtgaggcacacagtagtgtcctcattttgcagaggaggaaactgaggctcagagtgggggagatctgtgccgggaagtaggggacattggcctctttctcaaagcagacatggggggtggtcccaggaatatgctcacctgcaggcctgagtttgtatgaggtcgggggttggccattgacaggcaggatggtgacagtgaaggccacaggatggctctggcggtccatctcagaggcattagccatcaggacaaaaccgtcagtgtcttgctcccatcgtgcaggtactggatcagatgctcttccacctaggggcaggcccagggctggcagtcaggccccagcagtacccttcatgttctgcctttgggtgcaggaagagactgacccttttagggcctcagcttccattggtggaaaatggggaccataagttctggttcccagaggagttgtgaggaagaaaggggatattttattttattttgagacagagtctctcgctctgttgcccaggctggagtgcagtggtgtgatctcggctcactgcaacctctgcctcccagattcaagcgattctcctgcctcagcctcctgagtagctgggactacaggtgcgggccaccacacccggctaattttttgtatttttagtagaaacagggtttcaccgtgttagccaggatggtcttgatctcctgacctcctgatctgcccacctcggcctcccaaagtcctggaattacaggcatgagccacagcgcccagcccgagatacagcatctaaagcataggtctttctgaaatgtgactccctgtctcctctctgtataacccctggactgggagtccccggggctccctccactctgcccccagagctgggctgcagcccctgggcctctctcacagccgtacctctctccagcagaaggtgctgagggtcctggcttgaggcccatcctccttctgcagggccccatgccggggtggctccagcacctgcaggccaaggcccgggagagtggggaagcaggacctggcaacgcggagcagtggaggggccagggtgcagctgcgactgtgccccctctactgctgaagttttgtgcccccagtggggatgacagcaggcagcacctccagctccacgtgacgtcctcaaggggagcacccaggccgaggccacatccagcgagaaggcatgcctcagggcgggagtgcaggtagaggatcctgcctgtgtccactgcctcttgggagaagctctgcacggggtccaggctgggtggctcatctgccaagatgccacgcagcaccatcaccaggtagccggcactcggtgggctcttcactgagaaaacgatgtctgctggcggcactgcctcctgggctacctggttaacagaggtcatgaggactcacaagggaatgcagaggggtctcagaggggcccactgtggccctaagcagccagaacagccttgatcttgctccacttatttccccagataccactgctcatttagtgacacacacacatgtgggttcacacacacagcagccagacatgcagctggtcacattttttgtttttttgagacagggtctcactctgtcacccaggctggagtgctgtggtgtgatcacagctccctgcagcctcaacgtcctaggctcaagggctcagcctcccaagtagctggggaccacagtcatgtgccaccatgcctggctaatttttaaatgttttgtgtagagatggggtttcactgggttgccccagctggtcacatgttaatacccaccccacacatggttacggggtgtcggtcaacagcttgagatgcactccctcagggaggtgcataatcacatgtccccagactcagtgacacagacatatgagttcatcagatgctgacgcagtcacacaggtacaggtacacatgcgtgtgtgcacacgcacacaggccccctgctcaggatctgttcaggcctgtggctggtttgctggcagcatcctccccaacccctgctattaccacccaggaccatcagagggtgccctgccccaccccaccccacccctcctagaggcacaggcacccccagcacaggccctacagagctcacaccccaaaggccacatgggctccctcacctgatgggccatccacaagaggctaaactgcctccaaactcacattcctgttttgtgccttcggccggaatgttccttttgcgtggaataccactccccattctctgctcctaatggcctgtactcttcagagcccggcccaaacactgcctcctcccatgaggccttcctgatgccagatctgctggctcaccatgggccccaagctccagatgcagaccagaagggtctccgaaataagcagtgtggaagagtaaggctgagagcgggcaaggactggcctgaggtcacagggcatgtcagatctctggaaggcccgtggctgctctgtggggttcctgggtgagcagaagcccttgacagaccctcctggtcctggtctgggctctgagaagagagcggggtacacaggggtctgagaggcagcggcctgtctccacggccagcaatcccaaaagttcaggacccgtgatgccctcccagggaactgactgcaatgcagattctcgggctccacttcagagattctgtagggctgggtggcgtccaggaatctgcatgctcagccatgccatggacatgagtggacaccagctctagaggcacacaccactcccaggaggatgggtgtacagcaagctccccagaaactcttgggaacacaacatatatgggagcacatctgaggcacgtgcacacacacaagctgggaccaccacaggtacagcccaagtcacatgtgttcccggcatggaggctgggaggaaggccctctacctggtccacaccccgctcaccacctccagctcctcacctccagctggtcccttctgatctcagctgcctctccctggaagatgtagatctccttgtgctgggccagcttcagtggggctactgggccctctagggcaatggtcacttgtagggtggcatctgtgtgcactggtcccacatccattgagaaggccagggtgttgcgggagctgaggctgccattgtggccatagaaaacagccccaaccagcaggtcctgctgagagaaggctgtggctggctgagtggcttggagcaactgtccccagtgagggctgtctgtgacgtggtagtgggcctcatccctactgcagatgttgaggttggtgcccaggtggagctcggccatgttgatggtaccctggcctccttgaggaaccatgaggccggagccattggccacacagaggtaaggctccaaggcctgcacctccagcaccgtgatggcctggtgctgcccatcggacacctgcagcgggatccagccgtggtcagcctgagtgtgtgaacaggactcgcctcttcctgaggcccctcctggatgaagcggcagatgggctgcatgggctcatccgtggccatgatactgccagagaggaggtcctggtgggtcagcaccagctgggcctcagcaaagcccgaatcagcattgctgaaggccatgttgtctgtagtcagcagccgccacctaccccaggccacgtggaagacgcagctgatggtctgcataggggcgtggtcattcacaggctggatggccactcagaagacaccccatacctcctcccaggccacgtcaccactgctctggtcctgatggcagcaggaaatgggatatcatcttctgtgatctcggagtcatcatgctgctagaccagctggccatgcatcaggtctccattggtgaaggatgtcaccatagtgatcttgtcctgtgtcccacgccaagtcaacctcccatggcggggctgctccatgacctcatagaggtacctggcactgttgagactcttgatgaagagctggtcagcagagaggacacacccaccaccctcgggcaccacgaggacaggcatgtctgggtcaccgccaatatggatggagaaggtacagagtggggagaaatatggtggagctgtgacatggaaacagaaggtgtcctccactgccactgaggcatgtgccatggccccataggtcacctctgcagcctgtacgtcatcctgggtgaagccctgaccgtctgacagcatcgtgccctgtagttgaaagttgcctttcctgggagcctgaaccacctcacagtggaaggttggggggcttgggcctgcctcctccagggtggcctccaggtgggctgtggtgagggcctcctgctgggtgttctgagtgtgcagtggctccagctgcagcatccacacagtggctctctggatggtcactaggaaggacagattgctcaggatttcccagctcacctgcacctgcagatccaggttctccacggtgtcctcggtgtagtgctgtgggtcagtgctcaggtacctcacgtggccctgctccacatcctgctggtggaacgcctgtgtgacccaccactcagcatcctccaccccaccagccccctgcttctgcagctccctgaacggcaggcctccggtgacacggaacagcacggtcacatcctgccccacggcgctggtctccaccaacaggttggtaggcaagatgggcatggcagagccctgggccagatgcagccctgtgctgcggtggatttgtatggccagctggacagccaccaccttcagcatggccggggggctggcctgcagtccattgctgacccggaatgtcaagtcctgtgtagggccaccacagtggacatagactaggctgccggcctccaactcccagcaggagaactcagtcaccggctccccaggctggtctcggtgctccacggggaggccagagggggtgccaaggagctggaaggtgaggccctcacaggcagagtccaggtcataggcctggagaacctcaggccccagaggcttctgtgtgtgttccaggatcaccataaggctgccatgtgggaagatgatgtggggtgggtcattgacagggttgacctggatgggcaggaggtctgtttggcccctccgcaggcatgagggcatgggcaaccaagccatcactgacacctccagcaccagctggtcagaggtgtcctcagggccatcgtggatgaagcgggccttgcagttcaccacgtccaggagggtgaacatttttcatgcctgggcacccaggacatccagctcgagctcgctgtagtgtgcccctcaggtcacgctgaacagcacctgggatttacgcagttcagcctccatcagtgccagcatgggctgcacatgccaccactcaagccaggctgtgccaccctcggtcaccaccactgcgctgatagcagctggatgaaattggcaaagacaggaggtagccctggctcaggcacgcatggctcagctagctccacggacagccaagccttgggagccagggtggagaaagcttcataatggccataggcattgtctacctcctccagtctgcagccagccaccatgttgtgcgtcagcaaggcttcccacagcccctgcctctagccattgacactgaggtcttccatgcagccagcccagcagggaggcattggcagcccctggtgtcaggcctgagcggtgttcctggaggtgatgagaggcctctgcaaccagctccccaagaaggagactgtcacgtggctccaggtagctgaggactcctcagttcgtgtggggtactggtccatggagatttctagctggtgaatgttgatgtggatgctgaccttgtggggctgtgcgtcagtcacaggcacactgttgaggagcaatacagtaccctggcccttctcaaccatggaccacaggtggccctcaaatatgtccacatggatgaagtccccatgccagcctgctgcctggaaggccaagggtgcctgccagctctgtgtggtgagtgtaaactccagggttccttcatcctgagtgccccaggcaggcaaggcagccagagagtgggacccagagaagcccagggccacatcatcattggcagaaaactcttcagcacagccctcatgcttattgggggtcagaggctggaggagtctgcggccattgagagcggctgcatggaggcaacccctcaggggatggctggttcccctcaggtagggcaggccaagtctcccagtgctcccaacaaagagcccatagggacttctaggggggctcccaggactacagaggaggcattcagaaacccattgactgacaatgtgggccagtcctctgagacagtcagaactgtggtgtgggggacggagccactcagtagaatttctgctggggtctgcagcctcagctcctcctggcccaggacaagcctgacctgaggagagacggggaatgggagatggggggcagcactttgaatccatcatttcccttataaaagcacagtgggttccccacagggggccccagagcagaaaacctaggacaagggcctctggtgccactcctcttgccttcctgccatctctttattcatcctccaaacactcaccaaaggaaactctgggccaggcctggatgggctctggggaccctggtgtgaatcagatgtggtccttgcccacaaggaactgacatatagcaagatgctcttctagaaacccaacctgtatttttaaattctcctcctctttccttgagtgagaagcaccagaaatattgtcttggaatctagatttcacccctggaataatgggtaactgagaatccgttgatcagtccccctaagtttggcaaagtttctcgaggtcactgaaggaagccaggctaactgttcagggacagggagcccaggcagatgctctgtgttctgggaaaaaaaaaaaaaaaaaaaagctgcctgacctgtggtggaggaatatctcaaggagagatgaaggacatagttctgtcaccatgacattgacacaagaaatggctctggtatggtgctcccagatgctagaataggtgatggcagagtatgggaactgcagaggcagaacactaagaaccatgatcttggagtcctggtatggtgcatctctgtagggatgtggcatcactacctgcagagctcaacagccatcagcaccagactgcaccacataggtgttcaacagtgacaccttgtggcaatgagcagcaatgacagcagcagactgaccaagccctagtcctcttcccactggggtgtggaaagagatggctgccccaaatttgttaatttgttttttttttccttctaaaatagagatggggtctcattgtgtggctcaggccagtcttgaactcctaggctcaagtgatctttccaccttggtctcccaaagtggtgggattataggcataagccactgcacccagcctgccccaaatttggactaagaccctgggttcttaaactcttcctggtatggggtaagactcaagtaggagccacaagactccttgataataaagcttgtggtgtcttgaaggatgaaatggaaaaatgaagctgaggcagtactggtgctgttactctcatggacagacagtggtgctgcagataaattggtgcagtgccaccaggatgcgcaggggtcatgggggcccaggagggggtctcgccgaggaggaggggatgcccacactgaaacttcaaggagagactagagttcggcaggtacagggaatgggtgggtcacacacctggcaggaggagtgtgatgaccaaaggcctggcagcaagtgaccataagatggccaggaactgaaagcagttcagtgcagtcagagcacaaagggccagtgagggcttgtggtgggaaacatggttggaaggagccggtgggcagagccagttcatgaaggatttaccatttctgagctgctgctgcccatcccacagtggagaacttgagaccccaagaaaagtgacttacacaaggtcaacagccagctggggttcactcaaagctagacaaggaatctcgccccaatcccagggggacgtcactcacctgcaggtgtccagagtagagctgcagcaggaggtggtcagctgggcctgctgccaggagaaggagggcttcgggttgggacatggagaactgcagctgcaggtctatgtcagtcagagccatggccacagtcacctccgggtggttctaaccaaagaaggaagctgtgtgagagagggagctgtggtcaaggctcagattcttgcctggaggaggcgaggtgctgcagggagggatgggtgggttgcagaaaggggtccgtgctggtgcaccctcatggttctgccatacggtgctgcctctgagcactgcccagatcccagcatttccttggtcctggcaccagaaggcacagcctcaccttgtgtccagcccagaccttgacttggcaggaggtcagacccagaaattcccagcaactcaggtctcctccttggaggttcctggagccagaggcctctgccagctctgactcacctcccctgggccccagaggagtctccctcccaggtctggctccccgacctggcccaaagggaaacatcactggcctgatcacctggcttggtggtcacagccctgaggaatggagtttctggagaatcaccaccaggccagatcgatccctgctcagattccttctcctaagtgcccttgtgcttgggctcctgtgcagcacctgccgtgccatgccccacctccatgggttggctggggccacagctgggatctgggggtgatgtcagtgcagcccacctatccctgcttctccctcaggccattcttccagctgccattgagggtgggggcaggagcttattggcctgagtttgccaaggagtaaaggctctcaggccagatggggaccatatgcagtgtcaaaccaaagtgggcccacacttcctccactacccctgctgttgcttcctgctagagagctattcacagtccccgctgagcagtcagatccggccccattgtttccaccgtggccaaggaaccagggatgagaacagctcagctcccaacctccccaggccaccactcagtctgaggctgaagacagggcctagaaggggctgagggtctgctgagcaggccaaagagggcctccccaggcagaaggccatgtctgggcttgcctgggattagtggttcttatgcagggcctgttctgtcccacactgggactcctcctcttttgagttgctgcttcctccaggcagtttccccaaattagcctccctgacttccaacccgatgccataatttctggtctatgccttttgcggtgataagagccaaatataactttaactttgcctgcagatgtccagggctggggggcaggcaaacacaggttaaaaactgtgattcatccctgttgggtttccctcaaaccccaagaacaagcacaggctgatggccttgatggggtgatccagcaccgacctcacatgcactggtccctagccagcctgagccagctgccatctgctcgaggaagtagcttcagccattggaggagttggaggtttgtataccctcagggcagccagtcccacctggagggatatccaggaaagatcccgtaagagcccctcgggttgagttaaatcccctctagttatcccctcctcctgccagcactgctggcaacaccagcaccttggctgggaagctaagggaatcaagcaagccccgcagaccatctgcacgggggtggcccagcagtctcagcaggcacagcacagcttggtgccagcaagagacagaccagggaactgcaggtggcggccagctactggggtgccttatctgcaaagacattgattcctaagagcaaaacacagcacactaaagtgagggaggccatagcacaaggggtgggggcacatggccctgcaggatggagccaccacagtcaccggctggaacggctcacagcagctgccaggagccaactgttgaattttcaggaattttgagaggcaggtgatactgcccacagtgggaatatttataccaggaaaagaggcaaatactgaaaatcagggttccctctccccaacaaagccctttgcgaaacatttacctacccagcacccacggggaagggggcacatctccctgtgcctacccacctgtgttaatcagggttccctagagggacagaactaataggagatatagacagatatagatatagatatagatatagatatagatatagatatagatatagatatagatatagataatagatatagatatagatatagataatagatatagatatagatagatatataaaggggagtttatgaagtattaacttacacaatcacaaggtcccacaataggctgtctgcaagtttgaggagcaaggagagccaatccgagtctcaaaactgaagaacctggagtccgatgttagagggcaggaagtgtccagcatgggagaaagatgtaggctgggaagctaggccaatcttaccttttcatgtttttctgcctgctttatattcgctagcagctgattagaaagatggtacccaccagtattaaaggtgggtctgccttccccagcccactgactcaaatgtttatctccttttacaatgccctcacagacacttccagtaggtcaatactttgcagccttcaacccaatcaagttgacactcagtattaactgtcacaccacccttgcactaaaggtatacatacacccactagggcatggtcaaggtcagagatctgggccagacaggaactgaagtagatggttggccctaaccactgaaccacctgcctgcggcctcctcccatcagaagagagtagagcctgtttggccagagtggaatggtggcaggaagcagaggtactttccggagcgctggggtctgaatgggtccattgaggctgggccctgctgcttcctgtagggctgagtgggagaggctcacagaggctgccttgtgcagctggagcgcatagccagggaggcccccactccaacagaggcctctgaggccttgctggccggggctttggaaactctgacagcgctgcttccctcacctcctgatctcctttttctgcccctcttacactctctgaggggctgcagttgcaagaacccagaatctctgtcttggaggtagtggggggggggggcagttgaagaggggctttgaatggagagggtctgcacaataaagatgtaataagctaggagtcaatccagaggacttcctggaggaggtgatggtggtgtagagtcacagagagggaggaacaggcagtctcagaggacagcagcaaggccaagtgagagactggcagaggtatacaggtccccgttggctggggtgaggagggtttctgctccctcaccccccagagcctctggcttatcacaggataagagccagctaagctccaggggctttccaggaaaagtgtctcttggaaagggtgtgaccttttcatcggtcctgacagcaccctagaaatagcttggccttttccctcccctgagctccacagagaacacagccagcagaagacacattccctgtcatccagaaatgggtttgattctcagctgagggacagcaggactggtagagactgtcaggccacacagctacctacagagcacccccatgcttggtcgggggtgggagggatggcagggtctggctgtccacaggccgggcatgacagtggggcgcactggaagtggcgcactttggaggggcaatgtcaggggagagcttcctcttgttgggccacaagactccacaaggacagcacggtgactgattcccaatgctagaggcgaggcaatcggtcatgtgtaggtgtatgtgtgtgtgtgtgtgtgtgtgtgtgtgtgtgtatatacacacacatatgtgtgtatatatatatgagggtgtgtgtatgtgtgtgtatacataatttatttatttagatggagtcttgctctgccacccaggctggacctcagtggtgcgatctcgactcactgaaacctctgcctcctgggttcaagcaattctcctgcctcagcctgccgagtagctgggactacagtcacctgccaccacaccgggctaatttttgtatttttagtagagatgaggtttcaccatattggccaggctggtctcaaactcctgaccttgtgatctgcctgcctcggcctcccaaagtgctgggattacaggtgtgagccacagcacccagctatttatagatatttatagaatatgacctcaactatttaaacatatctgtaagggtataagtactttgataacaaagaagcaatacatactgatagaaactagctatcatgtcaacagtacttatattaggtagagaaattatgtgagatttttatttttttatattttactaatcttctcaataatggttgcttataagttttataatcaagaaaaaagatttctaaagtttttgcaaaatggaaagttatgcttctttatatactaaagacaaaaacaaaacttcctatttgaatacctttgacttttactgcagacttacagacccttgaaagaaaaggcaattccctcccactagttctggtgtcattctccccatctctcccttcacttccaccttggtcttctttctacttcccaccttggctagtggtctccacccaaaatgcttgcttggcttaatggttagaattcagggaaaaagagatcccgaattgctaatctaaactaagattatacatgtgggaaataataaagagaaaccaggtagtaaataagatttggaggacttaaaatacccagactttaattcctctaagattatagttattaatcatgtttttatataatattatcatttaacatttaatttctaaatataatgttcatgaggaaaagagaaaatagcttggtttctttccttaccgaactgttgtccttagtatcttctagacgttccagaactgatgtcagatttggctcatcagagtccacagaccatatcggtgaagaagatgaataggattcctgtttaacccagagacacctatgttaaatgtttacatacagactaacccaaatatgcaattaaaccacaccactaaatggcaagatgaccatggatttaaacaaaatgtatcagggggaaaaggcaacacgtttaaacccatgtgaggagctggacttctgagacagccattctccttgcatagcactgtctgctgctacagctcatagaagtcaacaattttcttcaacactggtaggcagcctctaaatggccctgatcaccctcacctcctgccattcacacccttgtaaaattccacccctggacctagtgactcacttctaacaaagagaatacagcaaaagtaacatcgcttctgaggtgaggctacaaggagactacgatgcctgccttagtcacccttctcctgctctttccattgctccctctgatggaagccagttgccatgtgatgaggtgccctatggagaggcccacgtgacaaggtattgtaaaaagcctctgaccaatagccatctagaaacggaggcccagtccagcagcctctgagatgaatcctgccaacctgagcttggagacagattctctccctatcctgccttgggatgatcacagccaccatcaacaccttcactgcctggtgagaggccaagccagtgaacccaaggtaaactggacagaatcctgacccacagaaactgagataatgtttgttattttaagctgctcaatttgttacagagcaatagataactaactcaaacaccataaaattctaatattttattctatcacacaaaccaagtaataccaagtaaatgccattactatacatatatttttgtaacacaattacatgtgattttttaaaaaagctaatgaactatgcattatgtgctttcacccactaacagacgttcccgctgttactttgtactgttctctattataaattggggaaaaaccattattattatatattagtttcagaataactaggttcaagtcacagaaaacaattttgcacaaacaactttaggcaacactgctttgaaaactgtaatctgagttaaagctgaagccacagaaaccaaatatttactgaaggttcctttttaagaaaagcaagatgggccgggcacggtggctcgcgcctctaatctcagcactttgggaggccgaggtgggcggatcacgaggtcaggagatcgagaccgtcctggctaacacggagaaaccccatctctactaaaaaaatacaaaaaaattagctgggcgcgctggcgggtgcctgtagtcccagctactcaggaggctgaggcaggggaatcacttgaacccaggaggcagaggtttcagtgggccgagatgtccactgcactccaggctggcgatagagcaagactccatctcaaaaaacaaacaaacaaaaagaaaaacaagttgtattgatggaggacatcattaacagtatatctcttcaataatggtttattttactattctcattcttctcattcctctcttactgtgttccaaatctctttacaggctaaaagaaactcttcagaattactcctattcttttttttcttttttgagaccgagtttcgctcttgttgcccaggctggagcgcagtggcacgatctcagctcatcacaacctccacctcccaggttcaagcaattctcctgcctcagccttcctgagtagctgggattacaggcatgtgccatcatgccccactaattttgtatttttagtagagacggggtttctctatgttggtcaggctggtctcgaacccctaatctcagatgatccacccacctcggcctcccaaagtgttgggattacaggcatgagccactgcgcccagccaaccctattcttaaagaacaccagttcctcagtattgcattttcttctataaattcttcagcatacactgagaatacaccatatggactatttttacacttttaattttcgtttttttttacttttggctaaggaaatttcaattagatttaggacttcattctgttaggttagtattttctagtaaacttcagcataagcaaaataaaatacgtgttgttgctctggactgaaacccctcaaaaccatattttaaaaattacaaaaaaaaattaactgaaatcaagtttttaaaaaccttgtagatgaaaagatatgatatctagtacgtctaagtacctatttcaatggttcccaaagtgcggccctcagacccccaagtccaaactattttgacaggaatactaacatggtgacatttgctgtaagtgtgcaaatacaatggtgggtaaaaatgctggtactttagcacaaacaaaagcagtaacaccaaactactagtagtcatggtattcttcattatgcacaggaaaggtttaaaaaggaagggtgggtgggacatggtggcctacaccagtaatcccagtgcttcgggaggctgaggtagacggatcacttaaggtcaggagtttgagacgagcttggccaacatggtgaaaccccatctctactaaaaatacaaaaattagctcggtgtggtggtgcatgcctgtattaccaaatacttaggaggctgaggcaggagaatcacttgaacctgggaggcagaggttgccttgagctgaaattgcacctatgtaactccagactgggcaacagagcaaaactccatctccaaaaataaaaataaaaaggaagggcaacaaaaggtcagtttcatttaagaatgtctatgataagtttgggaattttggctcatgtctgtaattccagcactttggaaggcccaggcagggggatcccttgagcccgggagttcaagacctgcctgggcaacctggtgaaacctcatctttacaaaaaatacaaaaattagctgaacacagtggctgcatgcctgtagtcccagcgtcttggaaggctgaggcaggaggattgactgaacccagaaagttgaggctgcagtgagctgtgatcacgctactgcactccagcctgggtgacagaacaaggccctgtctcgaaaattaaaaaaaaaaaaaaagaatgtctatgatgaagcagtgaatattttactatatctaaatcattgaatatatctttttaatatttcaagtgatgaaatgggaagtatacatgagcattcctacaggctgcctgaggaaaaacccttgagtgactaagtcttgaagtgaattaaccactttaatggaataccatttttacttgaaaggctgactgacaaaaaatgttattttaactcgcatttctggcagatattttctcaaaacatgagattctgtcatttcaaggaaaacaacagacaggctataataaaattcaataacaaaattactaataaaattcaagcttttgaacaaaaaattagaattttagaaaacttatgcccaccatcgctttccaaaagtattctgatgagattgatggtggtactgatgaatgtattttgatactgtacaaatgtatcaacatgtagaagatcttagtgaaccactgttttataagtgaccaatgcacgatgttgtaatatcatgcaagggtggaagatccaaagttcaagaaaaaccaagatttgatggagtatcaaaaaagaagcctaggcaacatggcaaaaccctgtctctacaaaaaatacaaaaagttagccaagtgtggtggtacacacctgtagtcccagctactctggaggctgaggtgggaggatcaccttagtccctggagactgaggctgcagtgagctgtgatcacaccactaccttccagcctgggcaacagggcaagacctcatctcaaaaaaatatatatatccacaatgatctaaaatggttatctgtatgagattggcctttgttcacattttttcaagaaaatatcacacaataaattgaatgcagaagcaaactgacatatcaatttgctaatgacatatcaaacatcatgcaaatgacatatcaaacatcaaaataatttgcaaaagatgtaagactgtactactttgggtttagaaattttcttttcataaaagcatttataacaatatgtggtgagcttttaaacaatattttaaatatttctgatttaatttctagtgataaataccaatagatataccctacataaaccaaagctccttgggacctcaatgtatttttaagagtgtaaaggaatcctgaccccaaaacttggagaactgctgccttcccctccactttcttccttctctagaatttcttccttggaagaaacatccctttgccattctatattaacttacatagttccactgaggcaagttttgctacctccctcccatctttccacctctctctcaacacaaaacctgaccaaagcattctaccagcccaccccatttccagtgattagctgtcaggtgggctaagccaaacaaatctgggttttccctgagactagacctctctttctgggagagatggaatcacagggacaaggttggccaccttggggtagtgagaattcatcctgcctaaacagggagaattcaaacaagtttctagaaagccaaactactttctagaaagtcaaagataattatattttttgccatgactgtaagaatgcccatttcattgcacactttctaacatttttaccaatctgataaataaaagctggtactgagatgaaaaaaaggctgggcacagcggctcacacctgtattcccaacactttgggaggctgaagtgggcaaatcacctgaggtcaggagttcaagaccagcctggccaacatggtgaaactccgtttctactaaaaatacaaaaattagccaggcatggtggcatgcgcctgtaatctcagctactcgggaggctgaggcaggagaattgcttgaacccaggaggtggaggttgcagtgagatcacgccattgcactccagcctgggtgacaagaacaagacttcatctcaaaaaaaaaaagaaaaaaaaaagaaaaaaaaagttcccatacaatataatttcttccatctctggaaacaaattcagcaatgagaactgaaagtcaccacgtggaaggtttcaaggatttacgtctacctactgatgtctaaagcattagttaagttacaaaaaaatacgcacacacgcgcacgcacacacacacatacccgtatgtattcagtaccagaaaacatgactgactacatggtaaagtcatccaacagaaagcacacaataactgaaggcaatgtagaggagtaagttataacatggatctacaatactgttgagtgaaaaagcagattacaaacaaatatctgatttttaagggagaggaaacatatacaagcacaggagaaaagaggtgagcagatgactggaaagatacaaatttctgacagtggcaccttctgagtggtagaattacataggtaatattttctagttttgcctaaaagttttctaaatttcttaaaataagaaggttttgttttccatattacaaaatatccatcaccccaggaaatttaacctttggcacaaactctacaacatgttcaaagtttgttcagttgaatatttaagagacaatctattttgaaagacatttaaaatgaccaatatttaaacctatgcattaatatttttcaatcacgttttaaattttgtaattttgataagttttagatccatcttgaaaagataaattttctgtttgtctttaaaatattacctacaatatgcctgtttttatacagttaatggtgctcaaaaatcgcaatataaattcaggcagtgttccttctatagaatgtgtaagtgcttctaatactgctctttttcaccagttatgaaaacacggaacaattatctaagcatctaattattcaggtcctttgtttctcctccattctgttagttttatactaatttcaaggcctgtgaggatgaagttgtctgtgacagctaccacaaaggttactataagcagacaaatttccagcaagtttatcaccactaccatcccaccataaaactgtctcaatcaagggcaacacaattcaaggttagtcaagacaacctctttacctgtcactgcttaagaaaaggattttttggtcttatttagaaataactttatctatttttctccataattccactgagaccaatgtgtgcctctatctcaagcaccagcaagcaaaactgcctgccagtatgttcagtttttgtatctttccaaatgtagggcacagctatcttttgatatcataattttttgaaaactgatgcacaaacttcttcttgaaagttcagccaggtgcggtagctcacacctgtaatcccagcactttgggaggctgaggcaggcagatcacgaggtcaggaattcaagaccagcctggccaacatggtgaaacctgtctctactaaagctacaaaaattagccaggtgcggtggcaggtgcctgtaatcccagctactcaggaggctgaggcaggagaattgcttgaacctgggcagcagaggttccagtgagccaagattgcaccactgtactccagcttgggtgatagagtgagactccatctcaaaataaaaaataaaaaaaagaatttcagatatacagcagttgtaattcttctgaaggctgcttatgggacacattactttcataatttgctgttcaataaatgtggggtggagaataaagtaaattgacagaattaccatataaaataaaattctaagtcctctgacaacaaaaacttacacacacacacacacacacacacacacacacacacacacacacacagctttccctgctaatcattttacaacaaccaagtagctaacccagagcccacaaaagcagagtcaaaattctaacacttggtaaaataaaaatgcacatatatccctgtcacctaaaaaaaaatgcttacgtattcaaagacagcaattgtagctactgagaacatcattgtaagcaaactgaggcagagaaaacaaacgtgctgatgaggatttgaaacacctaagctgcagaaacccactggatggtttcctaggttccgagttggcattatctttcagaacgatcttctagaagagatcacataacactgttacaaaggatctggagaaagggaccctggcttcatcactctggctctccagtcatgctttacattttcacttcttacactctctttcataggaagtcaatttacaggcttccaccaagcccttaagtgacgtttttgtactatccatgacaagttcttgatgttatgtctgcacttctgacaaattcttagcagttaacttactaggcagttaaggtttttgttcaagcacaatatagctagaatagggtcatacattcaataaaacaaatatttaccaagcatttattgagtggaagataaaaagcacaaagcataattataaaacattctcccctgccaccataaaaatttttttaaagccttacagaatatagcataacataaccaaagcaaaaataggactaaagaggggaggaaggggaaatatcagcatgaattaaatatgacccagaagagccttgatggtcagacacgtaaagacaaattgggtagggttagggggtggctgtcaggggcacattctacaggggaaaaacagctgatacagaagcctgaaaggaaaaccgggcagagcacctggacaggactcttacctgctgcatccagggtacaatgcgcctttccagaacacagcagcgacccggggtagagggatcgctcaaacagcaccagaggctgcattccaacttttcctccatcaacgagtccgttttcattgttagtttctccttaaacacgattggctgaacatgcgggaacaaggaaaacctgactgaagaacgaggcatttaagcttaagggccttggatctgggcgcggtggctcaggcctgtaatcccagaactctgggaggcagagatgggtcatttgaggtcaggagttcgagaccagcctggccaacatgatgaaaccccatctctactaaacaacacaaaacttagccaggcgtggtggcgggcgcccgtaatcccagctactcgggaggctgaggcaggagaatcgcttgaacccacagactgtcaagagatggaggctgcagtatgccgagatcgctccactgcactccagcctgggcgacagagtgagactccatctcaagaagcgcctgccaccatgcccggctaatttttgtatttttagtagagacagggttttaccatgttggccaggctggtctagaactcctgacctcaggagatccagctgcctcagtctcccatagtgctgggattacaggaatgagcactgcgcccggccaaaaaaccgaaaatcttaaaggcctttccccttccctcactgggctcaaacaacagcgggagccgccctgccacgccccgtcgcggtccaggggagcaggctagctgactgagggcgatcatgggccccaacaggtctgcgggcgacgcgggctcccacctcagggcgcagcgactggggcgagaggtgccggcagcccccaagccagccccgcggcaaggagccagagagacgcgccctccccctcctcccacgcaagcctcacacagcggggcgggccagacgcgggagaaaggggcgcgctcgccccgcctggggaaccggggcctctcccgggcaggctcccctttgtcccgggactctgggcgcctcctctccgccctcgccctggcccgtgaggccgccactgggcgcctcaccgtgatgttgcagtggagcgtgagctgtggcgggggctcctggttcttgtggaagatagaggccaacaacctcagcttggccttgaaccctcacacggacattttactctcacctctggcgggaggggcgcggaaggtgagcccgtcgggagccgctgtcacggccgcaaccacccgcgggacctctcggcggcgctctcccagctccgcctctccctgctgcctcaactctattcggagtagggctggaaaatggcaaggggcaccgaggcctctgcggggagctgtgtggcggcctgggcggctgctccccttgtaacagactccaccgacaggaggcgctgctcctgtcaagccgcagcttaaaagggcaacagcaccacagtccccgctaccgcctgggaaagggctgcccctaccccgctcccgtccctctcgcccctcacacccgtcgcccctcacccctcaacccgcgcgccccctgcgcacccgtttcggcggctgcaggagtccagagcatgcgcgcgcttccggctgccccctcctcgccttgacccagcactgctggacccatctggtccgttcttcacactcgcggactggaggctccgggcagcacaaccaccaactcgtgtgtgtgttggggtgggggtggggggcagaaaaccaccaactcgtgtgtgtgtgtgtgtgtgtgtgtgtgtgtgtgtgtgtgtgtgtgtctcccaagggaacagcactgctgagttcaggctatcagctcatggactgtcagcaaaatacagtcacaagaaggctatgtgctgttttgtctcttgcagtgacgtcatgttgctcatgttttatgtttttcagagttcattagtttctgtttgctctcagttaatatccagctcaatagattgtgtaagtagaatacccccaaactgaaagtcacctacataaaatatagtgaaaaatatgtcacccacttaaactatagttgaaaatatgtactcattagttttgtgtagccaacactggataatgggtaaggggaaaggatcccagggctagactgcctgggttcaagttccgatttcctgctggctgtgaaatacttgacagcgttcagcctctgtttcttttcttttttttttttttttttagcttaatcccaaatatgatagtaagtctcagtttcttgatctgaaaaacagaaattattcaatgacagtctatgtgaaaactttaaagttttcaaagccactatctagcttaggaaagtcctcagctttaggggttaaagtttttaaaaccactgcctggttcaggaaagccctcagctgtagccattattagctatgattattattgtggtggctacacatacattaatgaggcaggaaaatgctcaaggataacaagcaagtatccagattatctcatcagaccaagacagatgcatatgcatgcatgatcatgttttagctcagagccatttgtctaaaaggctcttgaactcagaggcccaggagtatcaactttgctttgcagtggagccatcgcttttgttaatcaatgaaattgacataatgctcttcttttttttttcctttttagcaccaaccatgtgcctagagctaagtgtgttaagaagagcatgcttcaagtggctggagtgagcaattcaacttgtggaggaatgagaagtgacagtgttgagacaagcaacataaaaccccagggtaaggtagaaatcactgaaagtcaggcaaaggaactggcgtccagtaatgagtcaggctttgccagcctctggccctacagatggctctttgcagaggaaaaaattaagccaggcccgagggcacagatcctaagggaatgctggcagctctaggctgtctatgagagtccagagatgctgcttcaccctggggctttaggcaagtccctttccctcccagagcctcagcatcccttctagcaaatgacgttctgcctttctcctaggatggctgtggggatcaagggagacagtggccatagggatactatgttaactgcagatgcggctgtaggagcactttgctaacttccagcgtgagttcagactcttcaggctatttggcacccagatctatggtgaggtgtgacatatgggatgtaaagtttgatgcctgctccgactccagtcttgctaacacacacgaaacctttggtaaatcatgaccctgccttggggaaaagggcagtctgggagagcttcttcaaggcagcctggcttcaatgcagtctggggcatgactgaggtaggcatacatggtgaggaactggagggtaactgggtaaagagctgcagtgtgggcagaggtgtagtgtgggtcacatcgcggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctctgaggtggagaaatgacagccggacattagtgagcaagccctgtctccgtgagcagcatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgtggcacgtgccggccggtgagggtgctgggcattgggaggtggcggggagggcgacgtatgcgtgttgtttgtgggcatgtgtgttagcgtgtgcatgtgggccgtggggcctcacagcatgtgtgtgcacactccggcatgtgcgtgtgtgtgtcccccacccccaggcctgccccacccatgcatgtgacctgccatgtgatttgaagctgtctttcagaatcactatcagtggcccctgaggagcgtcagccatggtaggtacatgcctcactgcctgctgcatgaatggtctgcctgccccgctgccccagctccacacagggggcatacctggagcctcagagccaggctccctgcccctcccttctggagctgcagacttgctctttcctctttctgtccttgtgctgctggctgtctcactttgctccctgtgagccacgggactcactgccactgctcaaggtctccatggctgagcctgggggctcttacaacaggctccatgcccaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccaagagccaaatccactgcagattaggggtgatagtcacggtcccacgtcctctatctgtcagcaatccagtggtgatctaggataaaagcctgagagtcctatacacgcggtcatcccacaacacacttcataggccatggaaggacacacagcccccttccctccctcccaggtaccatgatagctgctagcgtgcgactgaaggcagggtccctggcccctgctgaagcactactgctggccagcaggctcacgcaccttggcctgttgcttctaggggtcgcctgtgctattcagccaatagtgctgctggcccagctgagctccacctagagagctcacttccctttcctgccgcggagtctccctcttctgcttttcccagcaggaagggcccagcctcacctatgtaacctgcagccccccgccaaccagttgaggctgccctgttagacttagaagtctatggccaatggcatctggctacctgccctccctgccttccccagggtccctcagaggaccctgggctttctgatggcccagaggggcctctggcattcactccagccagccatcccttatagctccaccattttggttcaatcagtgttccttctctatcaggtctggtggctgttggatggggctctccaagcaagaggtggccctgggccgtgagttggaagacagggtgaccagagaagagagaagcccgagggggctgagcattcatctgaactatgggtggactgcctgggtgccatgaaagaggccagcgtgtgtggggtggggagggccgccgcagtccccaggcactacctatgaagctccggcttctccctccatcttcctcccctttcccttccagcccctcttttccaggaaccttgccatgcccacacctacgccctcccctccccggccctccacagctgctgcagcgcacccatactctgcacttgcctcaccagctctggcttttctctaacccgttttctctctgctttctctccaactgccagctgattgggtcaggcaagtccatcccatccggggagccccaggccccacttcgacctctaaacagattcctcctcttctcagagacctccctttccaagcctgcctgggtgggtgtcctgtgacttgacagtggctcccccagccccaaagccagcccccttcttctgtgacttagtctgttgtagtggtgagctgacacgtccaggtttgaccgttgctgaaacttgtgccccctctgtggtatgcccctgccctgttctataaatagctataaattctctctcacacacacacacacacacacacacatatatacatatatatacgtggccaactgcctcgcctctagcactgggaatcagtccccgtgctgtgcttgtggagtcttgtagcccagcaagaggaagctgtctcctgacatcgcccctccaaagtgcaccacctccagtgagcttccgggacatgcgcggcctgtggacagccagcccccgccatccctcccgcccttctggccaagcatggcggtgctgtgcaggcagctgtgtggcctgacagtctctaccagtcctgctgtcccttggctgagaaacccatttctggatgacagagaatgtgtcctctgctggctgtgttctctatggagctcaggggagggaaaaggccaagccatttttagggtgctgttgggagcagtgaaaaggtcacacccttttcaagggacacttttcctggaaagtccctggagcttagctggctcttaccctgtgaagccggctctggccactaggggacagggccctgaactcagcctggagggaacctgcggggcagccggcactctggagggacagacaggccacccggtgcagacaggagagggaggcagggggacagaacggaagacacctggggtggatggaagtcagtgcccttgggcactggtatctgtcttccctgccacagctagatcaggcttctcaaccagttggctgtcagggccagagtgtactccgtaggcgccatggcagtccccatgaaatccaccaggtgtcaccaggcagcatacaggtaacaggcctggaaggtccccaacagcccagctggacatgctgagacactctggggctcctcattcagtgggacaaactgcaggacccagtgagggaaatgggaacataccaggccgagcagtatggctaaatccatttattccaaaatcaaaagcaaaaaaaaaaaaaaaaacaggagtcccatcaccagggagccatgaccccatccccgcctccttcctcgctcctatgctagcaataaataagtttcccagtcgcgaataattataagaacctcttcctcatatgccagctgcaacctccgctaggtacgatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggtcttgtcttgctaccctaatggtaaagggctgactggggaggggttgtagggacatggtgggggtgaagactccagacccacttctccaggcttatgctgacaggggcctgcttttatttatttttatttttatcccatgatgtttttttaaatcccgtaacttctttttcagaactttttaaaaaaacttttcataaaactttttttttttacttttttcccacatctttttttgccacaacttttccacagtattttttatcccgtaactttttcatcccacaactttaattcctgtaattttttagtttgtgttcttttaataaacacacttacatggttacaattttgtaagaataaaaaccgattatctcatgccaagcatgcccagcatttgcacagtctcaatacctttaatactatagttttcaagacacacaaaatttttaggcaaaacagcaccttgaaacaatctaataatttattacattacagtagcatcacagaagcagtcaataatgccactttagacaaaaatcagtatttccatcatgcattctgtgtataagaattcataaatcggtaaaagtcgttctaagaaaacttggcaaatacagctttggactggaattggcatttctttctctacttttccttcccctagattctttgttttaagctacagtattcgtattttaaaatgttttaaattattttaagacattaatttaacagttacatttttgaatagttatttgaaagtgactgtaagataaagttttagagaatctattttggatagggttgatttacattttcacattttctaaaaatcagctttggttttagaactgattgtttttcatttcaggaaaacctatcaggtttaatctattactttaaaaataattatcatatattgcagtctttaaataggtattttgattctttacttcctacagaaattcaaatttattcagtcgaactcacattttaaaattctctctttctgctgaactctaaccttctaatattgccttctaagcaaattgaaagctgccttatactgaatgaggaagagaacaaatacttggctgaatgaggtactgcaagagactgcatgcactttgaagaaagacttgagttattgtcataggatttccattctctttagctttttcttaaacatatgacaaaatacctacacagagagtggtatttgagttaatatagtacatttatttttcagactgacattcagcttaaatatgccagtatgtgatttaatccacaggtacctgatgaacacattattgtcagattggttacagttgctaaacgctatctgaaggtcattcctagtcatttatacgtgtcagggtaaaagtgaagcgatttgaactataaaaatacctttgaaataatttatcaatgtattagataagctcagtttcagaatgataaacaaaaactgttagaccaaataacgtggctaattaacagtggtacgatttctagcccgagggtttaaaatggagttaaagtaagtgtctttaaactgaactcaaagaatgcaaaagcggcaagttcagacaaggcaagaacaggacctttagtccattttaagccataaatattacacaaaatatgcctctaactgaaactgagaggtataaaaacatatttcactcttcgtaaagaactttgtgaggaaatataactctgtgattgtatagacactttcctcatgacactttgacagtcacaaacagtagattgcgctgcagtttgtaaacattttacgttgcataaactgctccttgattttcaaatgtagtataatactgtctactaaaactcctttttgtttcaactaagtactctcacatatattagtttataataatgtttgttattatttttaaagtgttctccattcaaggaaaagaagtaaattcctatgtcagatggttgaagactagctattagccagagaggtctagatggtaaaatccatcttctagcctcaaataagctccatgaacacagaggaatgccaggtgtcacacagctttccttcactcgaattcattcttgactagagcctgtatatgcctgttccaggggcatttaaactcttaaaggatttcttctgatctttactaaatacattaaggagaacgccaaccagtgcccttttgtgtactgggacatgtagtcatgtgattaaaacagggaacatgaactctgactttaaaatgtattgtagatataaatgctctcagctagaaaaggttttccacatccacagtcatgatgggagcctttcattcctcagaaataatcccttttcaggtcatcaaaaaagagtacaactgccacagctcatgaggcagtatcttcatgagcccagagcacatacaaatcctaagggaactaccgtagtacagcgctcattcttggcaccagaacaaatgaaacatattctatcctgcacacacctgccaaagcaggccactttcctcttctgggagatttaaaaacctccccaaaatgttattactcccatccccaatacacagaaaaagggggaaaggctgtttccagtgctccacctttaaacaactgtaaatgtcagtactcacagtggcatattacaaagtaatagaccgcgcacttgagggcaaaccacatattgagctaatgaagagctcactgtgattaggattcgatcaaacataacagcagaacataaggaaattttatctgaattccgtaatgaatatacaggctgtactaacattaaaaaagcatggcagcctatcccaaaccagcaagaacagttgtgtgcatacagtgggtctttgtgtgtttgaactcccaccacataagggcaaactcgatatgcatgctaacgtcctataattatcaaattaaaaaaatgctaaaagatgccagagtgaacatgagagaaagacccactctcatttaactttttacaaataaatttaaattataaattagaaacacaaataaatttaaactataaattagaaacacaaataaatttaaattataaattagaaacacaaataaatttaaactataaattagaaacacaaataaacataagtggctctaacattcaaatgaagtaaatgaattgtgtaggatattaaccccttaaatgttttgttttttttttttttcaatttcttgacccgctcttagatgatggtgatgtttagctccctgttctccgcagcccgaaaagaatggcatgcagcctcttctgctcctcctgccgcctctcctgtaccaacagcttctccactcaagcctgggtgctcctggggagtcctgcattagaggaagcagctgctggatctgctgtgcagtggggttgtcatgggggagaaccctccctgtcctgtcccggtgcagcctccatgctatcagtgaggctcagctcactaagatcttcagagagagggagggggtgggaatctgggcacagtgcgagcctcccctgctcctgcctgcccaccccgcctgagggctctactcaccaccctgcttgtccgcacatccaagctccttgtgggactggggctccaggtactggtctggctgctgctgcagactcggagcctcttggctcttcagctccacctgccggaagaccctgggcatgaggacatgtggtggctggcttccagattcctggcccattaatagggtagcgagggcactgtggggctctgtggcctgcccaggcccctggccccttgctccaggcctaagagactgtctcccttgcctagaaccccatgcctccttccctagcatcaaatctcacgtcctttttcccagcatgtaaactgtaggccacagactggtggaaaagcaggcggagccaaccaccatctgctaagtgtgctacatgcctaatgtttccacgtattatctcatttaatcctcagcacctctgcaaggaaaaggctaacttccttttgaagttaaagaaacagagacttagagatgcaaagtagttgaattatgaccagtggaaccgaggccggaatccagtttgaatctaaggagtcttttttgtttttctgttttgttttgttttgagagagtgtcactctgtgtcccaggctgcagtgcagtggtgcaatctcagctcactgcaaccttcatctcccgggctcaagtgattctcgtgtctcagcctcctgagtagctgggattacaggcatgcaccaccaggcccggctaattattattattatttttaattttagtagagatgagctttcaccatgttggccatgttggtctcaaactcctgacctcaagtgattgtcctgcctcagcctcccaaagtgctgggattgcaggcgtgagccaccacacccgacataaggagcctcttataccactgtctcttcctctgtgattggggggctccatgcctctagctgggatgatgatgatgtccagacctgggagggccccagggctacccacctctaaaagtcagagggcaggaagcaagaaacagtcataggactgccccggagggtgctggggtcacctgtccccaggctgcagctgcctgtggcctggcacctcccctccccagaggctggtgcccgcctcccacatcttcttggatgggtcggaggttacagtctctttcagctcacccgacttctccagctcctttacttgctgctccaactgcagtgtgctcttgttctcgttgttctggacagagagaagcaatcagtggccacccactaaaactggagaccccagaacttagtgtctgcctcccatggcaccgggaagggtggaggcaggttagaaaaatatcccctctctcccacagccatcagagcggggctctggctcacagatgcctttagaagtaccatttcatgtgaaggctacaatgccccattttacaggtggggaaacaaaggccttgagggctagggaagagggcagcctccccaggtggggcaacgtaccagctcctcgaagccgctgcgtggctcggcccgctgctcgtacagggcttcccaccccagctccagcatcctctccagctcccgcagcctctccagctcccgcagcctctccagctcccgcagagtctcctgctgccacagcctctcatcctgttgccgaagcctctcctgctccaggagctcctccacctcgtccagcagcctctccctctccagcagcctctcctgctcctcctgccgcctctcctgttctaacagcttctccacctcttccagcagcctctcctgccctggcagcttctcctgttcacacagcctctcctcctgttcacatagcctctcctcctgttcacacagcctctcctcctgttcacatagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcatgtagcctctcctcctgttcatgtagcctctcctcctgttcacgtagcctctcctcctgtctcctgttcaggagactcaacatctgattgttttccacctcagcctggagctgtcttcccacactctctagctccttccttaggtggttggtctcatcttgtagctgctctaccttagatggccctgctgggggctctggggccaggggttcagctgagaaagcaagcagagaataagggcctctggattctcaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccttagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggggaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagacacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccgagactcacatccccaggtgagtggtaaccaccagaagtggctgtgtcagggctactgccattgactttctttttcctgttagctcctgctggaatgccagggctcttcctctgccaatatgcttttaactgtgggaaagaagagcagtaacactcatgagaatgatcagcccctacagccacatcctcctttacagttttgacaaaatacccttatataccatctgatgtaatgccaccaacaaccgtacaaggtgttgtcacaatcagtgactgagagggattcatatcatggatagaaaaaaaaaaaaaagaaagatcaaaaaaggcaatactggaacttaaactcagtcctctgactccacgctctggggttttgccatgaatcagcagcttccagggaccaaaaccaggggcagaggtagaaaagcacacattaagcaggcaggaactgtaggccgtgtggtttagagtcatacatcctcacaggtctgctagcgtgaagaagcgtaccagtacctctcacactttcatatcaatgtgtcctcatggcagaaggcagcttttctattaaatctgggaatttatcagaaagaggacaacccaagcctcatttcagagcaaagtctggtatacgcttggaaacctatgtgtctgtcatccccaagtacattaatgcattttctcaagagaatcaagggaaaatgatgcttcagaaagatgtcccgcatttatcctgtggcactcaaagtaccccaggttgagacgatatgaggaagattcaagctgtcaagttcagtttcccaagatctattccacagaagatgagcaaatctcacttcagaggccactgactgaagggcagtctggtcccagaaccgtggagaactcagaaaaaaatgttaaagtctctctggaaagtagaagcctgggaaaaaaccaaaccaaacccattctcccattgccacccagagatactgtgaacattttgagctcacaggggaagtgtaggcttttcccactgtcaatgtctatgttaagggagtaaggcagcctgaaacctcttgctcctaggtcccatagtctccactccccttccagctggaaatttgtgctgcaaccagaggaaccagaaatggggtgagaaaacttaggggactgggttgtaagatcaaaggctggtcttgcagcagtaatgacagttcctaggggcactgtgacatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgttgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaacttacagttagtatatgagagcagttctcaaaaatgtagtctctggactagcagctccagcagcacctgggaacttcttataaatacacatcctccggccccaccctggacctgatgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagattttgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctcctcttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtaagcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattcacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaatcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaacacggaacgactgtggtgatcgagtagccaaaagttcacggaatgcactgtcacaattgtgattccgccatagcgccgtgcatccatccaacacttgtttaatacctatatttaatacctaataccttagactgtcctaggctgtggacacagaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcggggtgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaatcaaaaaccctcaaattttccttctttttttttttttttttttaaatcaagaaagggggtagataggtttgttttgttttagaaatagtttttatagcagagtgataccgtcacatttaatgatcctactgtgaattcaagaattcacgatgaaagttggattgagcggtattttggtgttcattctttgctgatactcattaatgaagttcgttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggacttctaaccttttttttaatctgtcggttattttttgaaaagaagtggggcttaactagtgctctaaggattttaacaagagattccgatttagaaatctgttcccccttttggtgaaattattattttttttagagtcagaatcttcactgttgcccagttgtctccccgggacccaagccgtcctcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcgtttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctcagacttgtttaaggtagaactggactgggtgttaacagtgttagttcagcagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacatggacacagggagtggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagttaacctttgaacttaacagattgagagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaatttttgtatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcaccgccatgcctggctaatttttttatttttgtagagacagggtctctctgtgttgcccagcctggtctcaaactccctggatgaagcaatcctcccaccatggtctcccaaagtgtagggcttacaggcgtgagagccaccatgcccagcctgctggggtttttgattgacattgcattgaagctggaaatcagttaggaggcaactgacattttaataatgagccatgaacatggtatatctatgtatttagaccttagatttttcgtcagtgttttgtagtttttagcaattggatcttgcttgcattttgtaatcttacacatttatttcatgtttgtggtactgttgtgaatgatacttctcaatttccagttggtgattgctagtatataggaagatgattttatgttatatgctgaccttggattctacaaccttgctaaactcatttttagtactagaagcttttttgtagatttttggaattttgtgcatagacagcaatgtcactggcaaataagggcagtttaatttctttgttttcactttgtatacttttatttccttttttttttttttgagacggagtttctctcttgttgcccaggctggagtgcaatggcgtgatctaggctcgctgcaacctctgcctcctgggttcaagcgattctcgtgcttcaccctccccagtagttggcattacaggcgcccgccaccacgcctggctaatttttgtatttttagtagaaatagggtttcaccatgttggccaggatggtctcaaactcctgacctcaggtgatctccctgcctcggcctcccaaaatgctgggattataggtgtgagccaccgcttccggcctaagaggacacagtttctttggcttattaagaggtatttggttagtgttagaccgggggttggtacattatagcttgctgactggatgtaccatgctgcctctttttataaatgaagttttattggaacacagccacacccattcatttacatattgtttaacagagaccatatgacctacagaccctaaaatatttaccactttgcgcttcgcaggcattttgctggctactgctgtggacaccaattttaatttaggtagataaacttttttgtagcttctgaggttttgcattaatttgctcaggcatataggttggtggaagtgctttctgttccttctcccaaaccaatcacacagccatataacttcatgcctgagtttctgtgtggtcctctatagtgagtgagtttttacatacttctttgcagcagcatgaatttcaaaaatctcaacgcttttgctcttgctaatctttgtaaactttgtacacccagtgctggtacattctgatgatagtgcccacactgcactctatgaagaaaagactgatgattgtttatattaaaatgcaggaagagaattgtagcggcaacttttgcttctctaatcagcagcatcataagagacttactatgtgtgggcaatgggggaaaacgttaatttatacattgagatagttgtattaaaattgagtgactcttactgtgacataaagtgaatgtgtctcttatacagcagaaaactattaaatttgttttttctcagcagtataaaataaagtggaaaatgtgggaagaatacaaatccttaacttctgtgcttctgcttatttcacacccctcaaatttctgattcctttcaactgtagctggctttactactgagtggtgaaattgctgaacatacttaaaactacatcatttaagactttgaattttgacatctcctcctcttcacagtctttcaaatactaggcaacctgtagggttccactgtgtctgtcatgtgttgtccctgtgttacatgaaagcagccccagtgaacttgtgaatttgctcagtcatttcactggctactgggtgaggaagaagtaggattttctctcttaaaattccttggtgaaatcattggatgggcacggtgtgtttctttaattttccttttggtcaaaaatctgacaaagcaaagactttcagttgttcttggtctttcaataggtttagtttttaagtgtgtctactctgaccaaaaattgccttcctgtaatatgctccttcctttagaacacagttcttaagtagagtttgtttgtttaaatgtataaaaataagttaatgcattctatgcagcgaggttttgcatcagaaccctgagttctcaatgtggcaggtttaagtgtctagaacaccttttacctgttttttctattacttgcttttttatttttggggtaaatgatatctttctcagggaggccttccctcagcaccatgtttaagagggcatctccctcatttgctattccttcttctgttttattttgctatatggaatttgctactatgtgaaaactattttaatgttttatttacctgtgttacccctagaataatatctatgaaggtagggatttttatctgttccttctgtgcctacagagtgttgaggagtatggtgtctggcacgttgtaggtgcacagtgacagctgaattaataacgtcagggagagtttgtaggatggggctcaaggtgtagggcaagtcagtttttagatttgaggttattagcaggagacgatgtggggggaaaacacatgttttaatgtcagactgggtttgaatctggtctctccaacttaccctttgaccttggtgttaaataatttaacctttgaaagatcaactttttcactagtgaaacgggaaatagtatctttttaatggggattaaatgtaatatcaaatataatgctctgtaaatgttagttttgtctttccccttgtgtgccagcattgtggaagtctgaaagcaacctgaatttaccagtctgtttctggagccttctggggtcattactttgattacttttgacagatacattcttttcagcagcctgcattgccagcataacaatgacctgtccctttgaccagtgtgggggacagacactttgtcatccctcttttaatccgtgtatcagaacaactcctacaagttctggctttgaaacatgtttagaggagtttataattccgaacagttcagatgacatcagccctttcttagagtcctctgagtttgctcagcttcctcattccagtgtggcgggaaccattcagttaaattgatgtttgtggtctttacacatagtcatcctaagtttcttgcaaatcatgagctatcagagggctactaagtcactagtttgtctctgtagatttctctaatccaagcttgtccaaccgcagcctgcaggctgcatgcagcctgtgaaggctttgaatgtggcccaatacaaattcgtaaacgttcttaaaacattggccgggcacggtggctcacacctgtaatcccagcactttgggaggccgaggtgggtggatcacctgaggtcaggagtttgagaccagcctggccaacatggtgaaaccccgtctctactaaaaatacgaaaattagctgggcatggtggcacacgcctatcatcccagctactcgggaggctgaggcaggagaatggcttgaactcaggaggcagaggttgcagtgagccaagatggtgccactgcactccggcctgggtgacagagtgaggctccacctcacaacaaacaaaaaattatgagattttccttttttgcaatttttttaaagcttagcagctattattagtgttcgtgtattttatgtgtggcacaagacaattcttcttccagcgtggcccagggaagccagaagattggatcccgcttctttaagttttatggattaacaaggggttaattcctgtatcagtttcactgatgtttcttctgcttgatgcaggaacacttgacaagttagttaaggtagattggtccataaatttataggttctttcattcccatgtcctaggcaagtctgagcaggacctggaaagctgattaaaaggccagtgagcacagtgagcttaattgtaaattaaatggatatttaatacattaagaaggcactcaagcctttcaatctttcattttcatccatgcttgctatttgaatctgatgggcttgatattgaccttgttcttcttgtaaaaatgttggttattgctgcctttctcaagcttggttttcagtgtggatttctgcagataatttttgcacctaaaagtacaaagtcattaagtgaaggcagtcaggaaggaaagagtgccctgagccaggaggtctgttacagcacatggggtggacaagaaaatgaatggacatgggcatggaggtggttcagtcagtgtgggaaggccacctgcttgtcagctttctactgcgttgtccagcagaacacgttgaagcttggggcctgcaactcgtgtagagatgattgcatttaggaggctgaggtagattttttccctcttaagtgtgtgctcactgctttttggcgaagtcttgacccgagacatacacagcttgatctgtgaggattttaacatcgagatggttctgttatttgagttaggcatggctaggctaccaaggcattgcttttcagtccaaacatttggtcatttcaatttattgttagtgaggtttttgcgatttgttagaacacagagtttgggattttgtctgttttttgcatgtgtgaatgacacttgatattgttgtttatattgctggttagtatgtgccttcatttacctattgtgagtaagaaacttcctcagatcaaattatagtgaagtcgcttggttctgtttctctgactcttaagaggatgagatcactttatacacaaactcaagctgtttggtaaaggacctaccattctgagcattcatagcctagatgaagtcctggtccaatcaccaagttaaacttttaaaaaacatgctgttcttaatgttcaggaattcaaccctggaagccttctctaaatcttaatgagagttttatgagaattcatttagtgaaaatatctatcagggaatccggctattaactttgaggagggtcatgccttttagtggttagagaggcaagctgtagcctcccttctcagagaaggggaattgaggaagagggttctagtggtcccttgcaatcctcccctcactttccaggttccctagtaagaccggaagaagtccctgagtaaacagcattttgtgagtttgagggactatgtaaaaatgtaagtgaacatacaatggttttgctttgataactgttttaaatatcctgttggttgttgaaacttctgtgacggtgaagccttttttgtctttatttttcaatcggaagatctttcttccccacttgaaaagattgagtctggggtcaatccctgaccccgcttccttcctaaatctcttagtgtatagcatacagctgggcatatggtaatctcaggcacgggattgtactcatagagctatgcttgacacctaggtctttagatggcttctatatttttgatgacaacttttaattttattctcatttattccatttctgtttcagtgtcctgggtcatgaaacttaatccacaacaagctcccttatatgcgagtaaatcatacgatttcttttcattttgtatttatttgttctgtttacttgttataataagccacactctcacatgatagatcctcaaggaaaattttaaccatatgtgcatgaatatattggtgtaagacacttcagaaattgagtttgatttagtaagtactaaatggctaatctgtgcatggaactgaaaacaaataatacctgtaagacttgcgagttaatttagtcagggcgatagtatgcacgtatgaaacaaattgtcctgccaaacagtactgtagcttcttattttttacctgcagtgcattcctgtaaaagtagtgtggagatcctcctactgccactgtgatttacgttatgttgccactaggtggcactatgtcattggcaagagtgctgtgttctttaggactctgggtgaaagctgatatatcatctccctgaagtgagggactttgaagataaaattgataaatgattgaatcaaggctggaaaaggtaggctgtaggcgactattcttcattattgtaagagtgaattaattgaatttgggtggtgaaaagtacccgtttgatgagaagccagcttagggttgtggatggttagagctgtgagaggccagtagatgctgggttgctatgctctggagagggtgagaaaatatatttgtaataggacttgattccagccttcaagaatatggatcatttatttggacaaaacgtccccagaattagttgaagacaaaaggcaaatggtcaggaatgggaggcagtgaacatagtgttggatgaatagtggggggatggtcagtggaaactctggcccacccaagtttgtgtcaggtaataatgggagataagcctgaaaaggtggataaagctcaattgtgaaggaagacaaaggtgtgaggattttgttttgtgaccaccgaggagccattgatggtgtttaatttaaggatgcttttccttttatgcgtttgtacataaaaacataaatgtacttaaccattctgtattaataatagtcatttacctttccaacataaaatgttcatgtaacttctgcatagctgatttttacgttaaatgtaacatgtaaagaaatatatgtgtgtttttagaagacgtcttatgtgctcattttctttctagattacttggagataatttatgtttaccagtggttttgcatgtgaactgggtaccttgggttatttattattattattattattatttagaaaacgggtctcgcactgtcatccttgttggagtgcagtggagcgatcatagctcgctgcagccttgaagtcctgggctctaagcagtcctgcttcagcctcccgagtaactgggagtacaggcgcatgccaccatgccgagctaaatcctcccttttaaagtgtgtgattctttggtttttcgtgtgtatacagttttgtaattgccattgtctgaccagaacattttcatcaccccccaaaaaaagtgccatatccattagcagtcactcaccattccctgctcctctcaggctgtggcaaccacttgtatacttcctgtctttattgatatacctattctggaaagttcatatatatgtatgatatatatgatgtatatatgatgtatatatgatgtatgtggtatatatatgatagatatcatatgatatcatatatatcatgatatatatatcatatgatatatatatcatatgatatcatatatatcatgatatatatatcatatgatatatatatcatatgatatatatcatatgatatcatatataatatatctatcatatctatcatatataatatatctaccatatgatatcatatatctcatgatatcatatatctcatgatatatatcatgatatatatctcatatatcatatgatatatgatatataatttttgtaaatatatatgatatatcatatatatttgatatatatgatatatatgaaaaatatatatcatatatgatatataattttatatatttatatatagaaatttatatatataaagttatatataatatataattatatatatataaaagttcatgtatatataaaatcatgcaatacacggccttttgtgactggcttctttaatttagcatagtgttttcaagattcactcatgttagaacatgaatcagtaccttgttctttttattaatgaatgacagtccaatgactggttacatcacattttacttatccattcaccagttgatgggcagttgagttgtttccacttttggtctattatgcataatgctgctgtgaacagcaagttctggtgaagacatatgttttcatttctcttgggtatatacctaagagtagaattgcttgggtgtatgataactgtgtttaacattttgagaaattggaaaactgttttccacagtggctgcaccattttacattcctaccagcagtgtataaggacttcagtgtttccatgtgcttgccaacacatgttatctgactttctgatctatagccaccctaatgggcgtgaagtgatacctcattgtggttttgattgcatttcccaaatggcaaatgattttgagcatctttttatgtgcttattggccgtttttccgtatctttggagaaatgcctattcacatcctttgcctgtttttaaattgggttgtcttattgaactgtaagggttctttgcatattctgactacaggtcccttatcagatacatgacttgcaaaaattatctctcattctgtgggttgtcatttcacttccttgatgctatcctttcaagcaaaattttcagttttgataatgttctgttgttgatttttttttggcatcatatctaagaacaattctttgcctaacccagagtcacagagatttactcctatgttttcttctagaaattttataggtttagctcttacatttaggtatgtaatgtgagagttcatttttgtgtgttttgtaagggaagagtccaacttttttcttttgcatgtggatctctagatgttccagaagcatttgttgaaaagactgttctttccccaattgaattgtcttgggcatcgttgttgaaattgatcataaatgtgaggaattttttctggatgctgaatttgattcctttcatttaggttgtctttgatttctttcaacagtgttttgtagtgttcattgtataaacttggtactttcttgaaatttgttgcttatgattttattcattttgatgcgattgttaattttgttatcttaattgttcagtttttgattgttcattgattatatatagaaatactattgatttttgcataccggtctctgaaactgtagccttgtttcagaggtcaattatagactataatctggcttgtttgtttggcaacagctcttaagtggatgccttaggattttctatgtacaggatgaagtagttggagatcgttttcttcctttccaatctggatgccttttatttctttttcttgcctaatcgccctgagaagcatctctggtacaacattgaatggaagtggtgagcacaaacatccttgtcttgctactgatcttaaagagaaagcatccaagctttccccattaagtatgatgttgttaggtgtgggtttttcacaggtaccttttgttagatgaggacgttcccttctattcctactttgaccatttttatgatgaaaacgtgttggattttgtcaggtgattgaagatgctacactgctggcttagaacatggaggaaggagcctatgagccacagaatgcagctctagaagctggaaatagcaaaagaacactttctccacatagagactctagaaggaacacagccctgctggcactttgatttttaaacaagtgaaagtcattttggacttttgacttccagaaatgataacatgataataaatttgtgttgtcttaagccactgagtttgtgataatttgttgttaacagcaataggaaactaatagagtagtagtttggggaaattagtgataaaggataattgggtaggagaggataaatgtagttaggtcagtttgagttctctgtgtgtttcactgtgtgtgttttgtaacattttagtttttcctaaaaccaaaggattaattgaccttcaaaaggcagctactttttgattttagtccgtaaccttttatcaaatcagtattttccccaaatagggttgacaagaagcattctaaattatctcctaataagttgttttgacttcagatattgaaattgcaggcccgtctcccacccatctctgttttctcaccttttttgtacgttttataataagccttacattgaagtgtatgtgtctgtctgtctctccctccttcccccaccccctccctctccttccccactctgtgtgtgtgtgtgtgtgtgtgtgtgtgtgtgtgtaattacaaagaagttgtaaaggccttttaaagtagttatgatgtgatttcccctccttttaaaaaataaaatatgttaagcataagtattaacatcttagagggcaggtaggtggagactttgactttctactttatctttgaatcgcttaagtgtttacagtgagcgtgttatttttatggtacatagtaatttttgatgaaaacattttgaaggctgaaaagactgtcctgtcttttgaaaataaacccatctttttgtgctaattaacaccggaggccagctaaagctttataataaaatattgcattcaaaatacctatgaaagtggctagttgaagactataatttgctttgaaacgtagcttgaaatggaaatacatttctaataatgaaaggtgttgctttagtaataaatgaaaataaaatatcccattattatcccttcatagaaaacaaatacaaccctaaatgacattttaattaaccagtgattttcctctaaagctgagatttgtttttttaatatgtaggtaggattggcaaatagcgtacagaaatctggacatcctttgaagataattgttggggtggaatgggggcatagagtactgttttattgtgttcatttttattaatgaaactgaatttagaccaagcagtgatttcaaagtggaagatggaacaggatgtttagtaggttttgtagactgtttttgtaaaaggctttggtgcagaacctttcataaaatgaaatattttttcagcatgtctgttatttacttttagaattcagagcaagggttcttgtttgaagaactacaaacctttattgactccagatttgactcagctcttttatattttctttctcactgataagggaaggtactttataaagtagatttgtcattaaaaaagaaaaaaagactacatttacctggtcagaagttcttttgggtttaaagaaaaagattgcagcccaggttgcaacaaatggtctgacagttataatatgttccacctttcttttttttttttttttttgttttgagatagagtctcactcttttgtccaggctgaagtgcagtggcacaatcacagcttagtgcagccttgacctcccaggctcaagtgatccttctacctcagcctcacaagtagcactcaccatcatggtggctaattttttttttttttttttttttggagagacggtgtctccctatgtttcccaggctggtctcgaactcctgggctaagtgatccttctgcctccacaaagtgttgggattacaggtgtgagccaccacgcctagcctcaacaaaaattgaactatgtactgtagccaccctcaacagtgataaacttttggcaaatcttatttcatttatactccactttggattattttgaagcagattccagacagatcacttcatctgtaaatatttctgtttgtatctcttgaaagtaaagactcttttaaccatggatgagtgttttgatcaaatcaacatggcttgttcatgtcgataccatttgctcagaggggaaagattaagggaaaaatggggttggatttgaaatgccaggacctgtctactgggtttgtgatttgttattctctaaagttgtagctcttaaaacaaagaaaggagtgagtttggcctattcattaacttttcctctttagacagttcaaatgtttattgagttcttctacaagccaggcactgccttcttcttgcttaccaagaagcatttttatgcggtttctctaatgtttgggtgaatgggacctcattaagttgtttttcacacaggtgcgtgctcgttcctgaagagtcctgtccaggtgctctgcctgcttttcctttcaggcttctgtatcagctgctgtttccctatagaatgtgccctgaactccaccccttaaccctacccaatttgtctttacatgtctgaccatccatgaaggctcttctgggtcatattcagttcatgttgatatttccccttcctcccctctttagtccttactatttttgctttggtcatgttgtcttatgctatattctgtaagcctgttcaatttctttatggtggcaggggaaaatattttataattatgctttgtgctttttatcttccactcaataaatgcttggtcaatatttgtttcattgagtatatgacactagtctagctatattgtgcttgaacaaaaatctttttttttttttccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcgaacaaaaatcttaactgccttgtaagttaactgctaagaatttgtcaaaagtgcagagataacatcaagagcttgtcatggatagtacaaaaaggtctctaagggcttgatggaagtctgtaaattgacttcctatgaaagagagtgtaagaagtgaaaaaaagcaaaacagagtagatgttttactctgtttgccaagggatttgtgctatttttttttcctgttttataaatttgtcctaatcttaaataatgaagggaaaagagcactctttttcaacctcaaggaatcctttttatacttcttttctatgaagccatgttatgaaagattgttataccaacttaagtatagtttttccatcttcagtaacagacgtgattgccatctagttactggttctgatcaccccaaaatgcaaagcagcttgttctaataacttatgcaggcctattgggagctagtatatggctttgagtccttttgaagtatttaacataatttggcaattccattactccttttatggacttcttggcatctgtgaactcttggtagggaatcactgttttagaatgaaaaatatctcccaggaagtaaattagccagtaaacaaatgaaacttcattttttatatgacttgtagagcctaaattattactctttctgcataagtggctgctttctaggctgcttttagcgagattgttagaaacaaatgatcggtgctgtgaggaagaagcagcactcaggcaaaaaagttttctcagcaagacaatttgcttctgcaagtatgctgcttgcattagtcatgattgcaagagcacaccaaacggggtggagcaggggttcttatccctaacacagcccctgcctctgtgtcattccaacatgggctggggtaggactgcacaatcttagctgactcagttggatattgtgaatattttctctaataagaaagggagggggaatgtgagttacaggttgggactggtaggaagagttgcttacaaggcaggttactaagcaggtaactaagctggtaagtaggttcgagaaggtacagggaaattgttcttaggaacaaagaacaaggaagttgaacaagttaaacctttgaagaggaacttactgtacctaacaattcccccctcttaatttttgtaattcttcctcttcaaacttttttagcatgtctttgctttgctgttctgcttggttttctagaaggaaaagcttatctgaatagggtggaggagagttaggagaggttttggtaagttctgtgtctatgagtctttgcagtagtccacgaatgtatggtatgatacagcatccaacaagaataagcacacttataacgattgcaagagaagtaaatattgaggacgttaagtctttccattttccagaccatttctccattaaacttgtaaagggatcatttattccagaattgcttgctaactcattggataaggaggttaggccctgcaaagcttttgttactgttccgtcaggggctgtgttattaggaataaaagtacatcattggactccaatcatgacacagacaccacctttttctgctagcatcgtatctagggctatcctgttttcccagactatttggttagtgggacctaattggtcggctgttcccttaatagcatgtcttgtgtagttaacaaacctttgttggttgtaataaatgtagtttatccactctacatttttatttacagttgaccaccaaaacagcacagattcaaatcctgcagctgtttgatttcgggccttaaatttatctggtactcctcgtggaactccaatagcccctatataaatgtgggagtcaaaggacccatgaagggcacttcttctcttatgattttctcttctattatgttaatggaatgctagggtgaaagggatggccagttggactagagcaaaagtactactacagttacttggtggagtgtccagtaagggtccaccacaataccaccatacgtatgctcgaggatgaacaagggcagactgactggtaagctcttgggaacgtttaagttcaccacatccctttaggtctccatgaaatgccaagttttccccttgttgtgagagacccgaggtaaaaattggtgtcagtagacggaggctggatggctctcaggggctgacctgcagggtgttggacttcagggaatagcagagagagaacttggcaggattcattaccccaggctgtggggtcttggagaagagctaccatacagctcatgcccagttggctggaagaccatccgagtggaaaggggacaacctgggcctctggcttactgtgcacacaagtctaacaattgcttttgtttagagtgcggacagaatatttaatccattctaaccaagcatttgcatcttggtaccctgtctcaattgctatggttggtttcaaatttttaacttctacaatggctaccttgattttatccttggttgaaggaagaacagtggtttcgtttggagagagtgtagaaggaggtggaggaggtgagaaagtaatgaaacacatttcaaaggattctataagatgtgtccctgctattttggctcccatgccgtataagcgacttaaagtaggtttagggttggcagaagtggggataagaatagaaatttgcactggattacattggttatactggcagttggggggcgggggatgtttcctttaacaaagcaaacatggttttagggacttactgttgacaaggtccagccctgatgttcagttgtccacataatatcattccagctatggcaggcctgtttccctaaatttcttaaggaacaagagtcgtaacgggggagtcttttgtctgaaaggggcagagatacttctctgaggctgagagttgcttttgactttggagatctccacagggtataacaaggcaagcatcaaaggtaatagtttggggtgagctcgacctagttacattaataacgagaggactagcaatagaaggggaaaagaaatacagcataagaggatcaagcccgttttagctttaacttggttggagttggccctgaaatagctgtccatgattctggagtgggtggtgctcttttgactcaggtatggtgagtccattcttttttggtggtgtggaagactgtctcagtcattagaaacactggataaggataaggtccctcccaggtgggcttgagcttcccttctttctaacctttgatgagaatgtggtcactgtccgggctggtggtggtgaactggaaattcaaggggtggtgtatgtgccaagaggcctttagtcctaaggaaagagaaagtggaggatagaccaagtatatagttcttgagaaacagatcttttgtttcgaacgaggaatgtcagcagtggagtgtagataaggcaactcatagagcatttcataaggaggtcagccgacatctttcctaggggcagtttggaatcttcacaaggccatggggaggcatttagtccatggcaaccgagtctctaggactaatttggttaggtggtttttcagagtctgattcattctttctactcttcctgatgaaggtgggtgccaggggttatggtagtcccatgttatatctagtacttgggctagtttcttaagaacatgtgcagtgaaatgagtcccattgtctgaatcaacattttctattaatccaaacctgggtataatattttcaactaatgccttgagtacattactagcagttgcacttgaaaagggaatagtttatacccaatgagtaaggtgatctatcactaataaatattttaagtgaccaattgggggcatttcggtgtaatcaatttggacactttggaacagccttaatcctggatttctccctccaacaggtggttttctgaggatctgcttattagtcttcttacatactaggcaactatctgtaacttgtcttgccaaaatataaattcctatatatctgtagaccccgaggactgcatcacacgtagcttgaggtccctaatgagtcccgtgatgcagatgagagagaatttccctcatgaggggtttggataacatttctctttggtctggtgacacccatttcccttctgaattttctttggctcctatttttgttaatttttccttttcagcgggagaaaagatggggactgcagtcgagggaggaaggcaaggggctaagtgaaaaacaggcattttcagaggaaacggcagtgtgtttggctatttgatctgctaggttattccttccgctttgaaaagaaagacctttctgatgtcctggaacatggacaatagctattctggcagctgcaggttatctaattcttggatgattaattcttcgtggcccaggtcttggcctttgctattaataagacctcgttcagtccaaatttttccaaaggtgtgagctaccccaaaggcgtacttggaattagtataaatagtcccttcttggttttgcaagtgctttaaggcttgatttaatgcaaacaattcacatgtttgggcagaccaattatttggcagtcttctggactctgcttcttcaagtgcctccccatctacgactgagtacctattatgcctttttccttcaattacttgggaagagccatctataagtcctgccccgttttgtaaagggtctctcttaaatcaggcctaacttttgtatgataattaaatctaaacacttatgctcaggtctctttagatttggatctccagtcaggaaacctctgggttaagtgaattatcattagtgttaaatcatctctttctaacaggatagcttcatactttaaaattctcaagtcagtaagccaccttcttggcttttaatttaagatggttctaacctgttggggcatgcttacagctaactttcccccaaaggttagttttctgctttctttagttaacaaggtgatagctgcaatggattgaaacattcaggccatccacaggttactggatctaaaacttttgataggagatccatgggttgctggtgacctctgtgttcttgggtaaggacacctaaagctacccccttatttatgttaacagaaaggtgaaatggcttttctagggaaggcaaagctaaaacagaggcagttataagcagatgttttagctcctcaacctggtggagttcttcagaagtccacaggagagggttaggcttttcttgggtgagttttaggtagagaggctttgtgactagggcatattagtcagtctataagtggcaatatccggctatccctaggaattttctgagttcttgtttagtcttaggcaaaggtatggatacaatcccttcaaccctctcaggccctatccttcgtttgccgttacttataaagtgtcctaggtatttaacttcaggctctatgaattgaagctttctctttgaaacccatagtccctctccttacaaatggttaaggatatggatggagagagcagataccttttctatagcttaaccggatattaataagtcatctacgtactggagcagacatatacattttggggtataaacttgttctaacacttgttctagaatttgaccaaagagattaggggaatctgtgaagccttggggtagaactgtctatcgatactgttgctgtcatccatagtggggatcttcccattcaaaagcaaaaatgtctcagctgtcctcatccaaggaacatgctcaaaaggcatcttttaaacctattactgtaaaccattgatgttcgtatggaattttactgagaatggtttaaggattagggacaacaggatgggtagtctagactgtctggttgatggcccagaggtcttacgctagtcaatatgacctatctggtttcttcacaggcagtattggggtgttataaggagacatagagggttcaaggagcccatccttgatgaggctttcaattataggtttcaggcttattctgccttctaaaggaatagggtattgctttcttcttactatttctccatgggtttttaactttatatgtatagggggcatttggagttttccccaatttccttcccttgcccaaacatcaggatgaatgtatgttttcttctgcagtggtgagcaggtttaatgaagtgtagaatccttctgagccaatacgtaaacctatacctaattttaacattaagtctcttcctaatagattagttcctggaattaacaaaaattcaacattagctgagcagtttttacatctaatttctgtttcttctaaaatttttagtttgattccctctccttttacccctgagactacaagctcctctgaggaccaggttatactgtggggaaggtaacaaacaggagcaggctgctcctgagtctactaaaaaggtcgtaagctcagatttgggtcccacttgtaaatttatcaagggctcttggtgggtgggattcaaggtaaaagagagagagcccctaaccccctattcctcctcaaaggtcgtaagtgggacgacttctctttctgattttaattcgggacaatacctcttgaagtggcctactttctcacaattgaagcattgattctgtctcatttatttttgggtttctcggctttgcctccttacgttctttatatggcttaggaagtgggggcctaggatctttataggttttggctctcgggaggctttgtttgggagtgtgtgggtctccgggtaacagagagtaatactggtgtgttttatcctttggggccccctgttggaaggtggataacatagttttcattttttctttttgcttctcctcatccctccttacacacactttttgagcttctctaagaagttcattcatgggacggtcgttccaattttctatcttttgtaatttccttgtgatatctggctgttagtaacaaaatgaagctttaacattcactgcctaagaggatcttctaaatctagaacagcatattttctcatttgttctttcaagctgtctaaaagtttgataggcccttcatctttcctttgttgtatgtcgaatgctcgagtaagattttgggttcggagtactgactcctgaatcccttttattatcatttccctaagttcctgcatatcctcttcagtgggctgtgttattattgtcccaccgggggtcttggttggggaatttttgatctgctgcatgaatgtgttttggccaggagggtgttcatgttcccaggctaccatagcagctctacagatcatgcttctttcttcccctgagaaaaggatgcctaggatggacattaactcagcccaagtatatataactgtggtcctagaaattggttaatttgatctgctgttccacaggagttgtctaatagtgcggcttgaactctgtttttaggttttggacctcccagctggttaaaggagcatttacaaagcgaatacttcctcctcctagggacacctgtcttaaggggaagagaggtggagctaattctcccgaggtagaggggaaggggaagttctgaatatcccttttacattgctctatctcacattgaaatcctttcagggaagagtacttagggtggtagtgagcaggctcttgggacgattcccaggaggcagggttatacagagggggaacaatgtgggtaggaaaagggtctgggacaactgcctctgcttgagggggagggaggttaggtttaggggtattggacggaggaaggtggtggaggaggttccatgtgttggtgagctgtctaggaacagggaccttatctttctcagaggagttaatttctgacttgcttttcaggattgattcctgagtccaaatgaaacaacaatattttatcatttgctgctttttcttgtattgagtcctttcattctctttccaatattttagcataagccgtaggggactatcaggaggaatgttattgtcaacttgtacaaaggaaagaaacaaaccttgattcaggagcctaggactttttctttggtttgccctcctgggacagattaccgttccaaattgaatttgtggaggagcgttgggaaatatcagaactgtcatattaagcacctaagtggtacttttaatagaggagttattcagaaattatattaggcagatagagagggtaaggaggcctcagtaaggctttcccttttaatagaaacaactccagaaacatttctttttcttttctttttatcttttttttggagacggagtctcgctctgtcgcccaggctgaagtgcagtggtgcgatctcagctcactgcagcctctgcctcccaggttcaagtgaatctcctgcctcagcctcctgagtagctgggactacaggctgccaagctttgatatgcaaataccagcgcttagaaactgtgtccattcaacatggagattcccaccctcttcttctagtcaccacctcaaggtgacacctccagatgaccccacgtgtgcaggacaacatggtgacctacatttgcatattaaaaggctagggtgggagggccacgtttttctcgggctgcatgaatgacctgcctggtcaaaccaataccctggtccctgtgcaaatcagacaccacctcctccagcctcccaatataaccgagtactgttctgccacacacggggctttttctctgttcggagcccccctttttctgtaccgcagggagcctttcttctttcttgcctattaaactttctgttccttaaaaccactcctgtgtgtccatatcgtttaactgacgtgacacaaaggaccccgatgtttctccagtcatcagagccatatcactttgagtccagaggaattattgttttcatttatctgaatttataatatagagtcaaattcctagtggttatcctctctcatccccatttttatagccttccttgaaaggaacaggtatatgaagaggagacaggtttcccttttgtgaatagtatatcccttagtatcttgattttttttggtgggagtcgggggagttaaacttacttagacctggtaaagggcagtatttgataaatgtcagctagtttagggttagggaattgagttgaatggagatagtcactgccaaatgtaaagcatgactggagagccagagtgatgaagccagggtccctttctccagatcctttgtaacagtgttatgtgatctcttctagaagatcgtgctgaaagataatgccaactcagaacctaggaaaccatccagtgggtttctgcagcttaggtgtttcaaatcctcatcagcaggttcgttttctctgcctcagtttgcttacaatgatgttctcagtagctgtaattgctgtctgtctttgaatacttaagcattttattttagctcacaggggtatgtatgcatttttcttttaccaagtgttagaactttgactctgcttttgtgggctctgggttagcaacttggttgtttagttgtaaaatgattagcagggaaaaccgtgtgtgtgtgtgtgtgtgtgtgtgtgtgtgtgtgtgtgtgtgtattttaagtttcttttgttgtcagagcacttcgaattttatgtggaaattctgtcagtttacttgattctccaccccacagttattgaacaggaaagtgtgaaggtaacgcgtcccataaccagccttcagaagaattacagctgctgtatctctgaactttcaagaagtttgtgcatcaattttcaaaaaattatgaaatccctgaagatagctgtgttctacatttggaaagatacaaaaactgaaccttctagcaggcagttttgcttgctggtgcttgagatagagccacacactggtctcagtggatttgtggagaaaagtaggtacagaaagttatttctaaataagaccaaaaaatccttttcttaagcagtgacaggtaaagaggttgtcttggctaaccttgaattgtgttgcccttgatagagacagttttatgatggggatggtagtgatgataaacttgttggaaatttgtccacttatggtaacctttgtggtagctgtcacagacaacttcatcctcacaggccctaaaattactataaaactaatagaatggaggagaaacaaaggacctgaataattagatgcttggataattgttctgtgttttcataacaagtgaaaaagagcagtgttagaagtacttaaacattccatgtaaggaacactgcctgaatttatattgtgattttagagcatcattcactgtttaaaaacaggcatattctaggtaatattttaaagacaaatagaaaacttaccttttcaagatggatataaagcttaaccttatcaaaattacaaaatgtaaagcatacgattgaaaaatattaatgcataggtttaaatattggtcatcattttagatgtctttcaaagtaggttgtctcttaaatattaaactgaacaaacattgaacttgttgtagagtttgtgctcaaggttaagtttcctggggtgatggatatttgataatatggataacaaaaagttcttattttaagaaatttagaaaatttttaggcaaagctagaaaataataccaataattctaccactcagaatgtaccactatcagaattttgtatctttcagtcatctgctcatctcttttctcctttgcttgtatgtgttccctctcccttaaaaaaatcagattttttattataatctgcattttcactcaacaatattgtagatctgtgtcataagttattcctctacagtgccttcagttattgtgtgctttgtgttggataactataccatctagtctttcatgtttcctggtactgactacataagggtgagagagagagagagagagagagagagagagagagagtgtgtgtgtgtgtgtgtgtgtgtgtgtgtgtgtattttttttctaccttaactaatgctttggacatcaacaggtagagctaaatccttgaaaccttccaagtggtggctttcagttattgctgaattggtttttagagatggaacaaattatattgtatggaaactttttttttttttttttgagacaaagtctcaccttgtcgcccaggctggagagcaatggcatgatcttggctcactgcaatctctgcctcccaggttcaagtgattctcttgcctcagcctcccaagtagttgggattacaggtgcttgccaccatgcccggctaatttttgtctttttactagagatggggtttcatcatgttggccaggcttgtctcgaactcctgacctcaggtgatccactcaccttggcctcccaaactactgggattacaggcataagccaccatacccagcctttttttcttctaggtaccagcttttatttatcagattggtataaatgttagaaagcgtgcaatgaaatgggcattttcacagtcgtggcagaaagtataattatctttgactttctagaaagcagtctggcattctagaaacttgcctaacctcttcccatttaggcaagatgaattctcactacccgtaggtggccaaccttgtccttgtgattccgtatcttccagaaagagaggtctagtctcagggaaaacccagattttcttggcttagcccacctgacagctaatcactggaaatgaggtgggccggtagagtcctttggtcaggttttgtgtcaagagaggaatgtggaaagatgggagggaggtagcaaaactggcctcaatggaactatgtaagttaacgtagaatgacaaaggaatgtttcttccagggaagaaattctagggaaggaagaaagtggaggggaaggcagcagttctcaaagttttgaggtcaggattcctttacactcttaaaagtatattgagggcccaaggagcttttctgtatataggttatatctattggtatttatcactaaaaattaaatcagaaatacttaaaatattccttaaaagctcaccaaattttgttatgaatgcttttatgaaaagaaaatttctaaacccaaagtagtacaatcttacaccttttgcaaatttcgttgatgtttgatatgtcatttgcacctgcattcaatttattgtgtgatatttgcttgaaaaaatgtgaacaaagaacaatctcatacagataggcattttagatccttatggatattttttattttttatttttttttatttttgagatggggtctttctctgtctcccaggctggaatgcagtgctatgatcacggctcactggagcctcattctctggggactcaggtgctcctcccacctcagcctccagagtagctgggactacaggtgtgtactactccacctagctaattttttgtattttttgtagatacagggttttgccataggtattcaaatagaaagttttgttgttgttttagtatataaagaaatataactttccatgttgaaaaaattttaaaaacctttttttaaattataaaactcataagcaaccattgttgagaaaattagtaaagtacagaaaaaagaaaaaaattaaagtctcccataatttctttacctaatataaccactattgacagttgacatgatggccattttctaccagtatatgttttttctttgctggtaaaatacataacccttacatatatgtttaaatagttgaggtcgtattctccataggtttatattcttttttttttttttttttgacgcggagtctcactttgtcgcccaggctggaatgcagtggcgtgatctcagctcactggaagctccacctcctgggttcacaccattctcctgcctcagcctccccagtagctgggactacaggcgcccgccaccattcccggctaattttttgtattttttagtagagatggggtttcaccatgttagccaggatggtctggatctcctgaccgcgtgatctgcccaccttggcctcccaaagtgctgggattacaggcgtgagccactgtgcccagcccttttatattcttttaaaaagtatttactgtattttcccatgatgtcatagtctttatagaaaaataacaatcattattttcagttgacatgattgtttacctaaaaatatccaaaggaaccaactgaaaaaaaacaatttttaagattactggttaaaagttcttttatataaaaatcaatagccttccccaatgttagctataatcacatagaacatatagtgatgaagtattttttcaggtatttcagcaaaaattaaatacctaggaataaacttagatgtgcagggcttttatcaaggacatgacaaaattttgctgagaggaatgaaagatttgcattctatgttcctgaatgagcagatttcatgttataaatatgttatcaccatgtcttcatattaatttataaatgtaatttctgctgggcacagtggctcatacctgtaatctgaacagtttgggaagctgaagtgggtagatgacaattagctgggtgtctgtggcacacacttgttccaactacttctgaggccgaggtgggaggatcacttgagcctgggaggcagaggttgcagtgagccgagatctgcctctgaactccagcctaggtgacagaataagaccctgtctcaaaaaaaaaaaaaaaaacacacaggaaaaaaaagggtgtatatatatacacattttatatttcatatatatatttatatataaattttgtatatatatgtatatatacaaatttcagtagaaattccagcagatttatttttggcatttgacaaaatgactctaaaatttgtttagaagagtaaataataaaaattaataaagtatagactctttcaaccagatattaaataaaatattgtggactagccctgggccagacagataaaggcaatgaaagtttagaaccagagtcatgcaaatgagaatttagtgtaaggaaaaggtggtgctttaacttagtagtgaaaagacagattattctgtaaatagttttaggagaactggccatttgaggaagtttgagtcttaactccaatttttgtcaaaataagttgtagttggtttaaacacatctattcttaaaaattagaacagaagaacatcgatttgaagatattttaagagttaaggctgaggctgggcacagtggttcacgcctgtaatcccagcactttcaaggccaagttgggaggattgcttgagcccaggagtttgagatcagcctgggcaacatagcaagactctctctctctagatatagatatacatataaatatacatatagagatacaaaaaaagagttaagttttgtatggagagccatgaagataagaggtgaaaattaaaggcttgatggacacatgtttacatctccagcaagggggttgatgggaaagactgatagacatagctccattactgctacctccttttaggaagttgcttctgaatatctaaagataacagttttataatagcagaaatgaggtttttttcagtgtctaaaacattacatgaaatacatacatacataaacatgttcaaaagttaaatgaagtaggatataaaattgggcctagtgtttaaaacaataaatatatttacatgaaggagaaaacaactcacttcccactcttacagcctctgccagtttatcatagcctagtttcttgagagaataagctacatgtcttcaccttttttcactgaactcattataatctggattctgccttcatctttgcgctaaaatttatctcctcgtttccaaatccagtggctcccctcttagtccacaaattgactcctctgcagtattttgttaatgttgattgttcctttgttgaaacattcctccgttcttaatgtccaccagcaaagagttggttaaataaaaattatagtgtacagttttataatagaatattctgttatagaccaaaaaaaatgcagccagtctttccataaaagcatgtgcaaacttctaagatgtattaagtaaaaaagtaaggcataaaatattgtgtataatctgacctctttagtatacagtgtaaaaaaatctatgtctgtgctagtttatacttacttttttctcccctggtggatacaggaaattgtgagtagtagaacacaattaaaaaagactgtgtggcttctgtgccaggacctgtgatagttgggtataaaagacaaaaaaggcatgtccctgtcctctgggaagggacatgatagtcgaatgggacttttatcagattgttttctcctgttttgatcttatcaccctgccttggtctcctccgatctcttcttccttgtcctacttctttcttctcttctcattctgtgctttctctgagtaatctttgactcccattacttaagtcatgacctgtgttccagggactcctaaatttgtattcatctccggagtttcaaacccatatatctgtctgtatatcatatatgttagggaatctcacttggagtgacatgggtgttcaaaatgatggtatttaaattttcatgtattcacctcctagcactctatcagccccatcatgtgtcccatcagtaattctccttgtcattgtgagtgggacaaaatgaaataatcaaactagtcacccatgcctcaacctgggaactgtcttagcgttcttttatatgctactgttctctgacctcccccccaaagtacgtttctaagacctgtccttctaaatgtctcttactattttccctgtgatctcagtttcttcttcccatccctcaaatgctttttgtgtgtgtgtggtgggggaagagagtaaaattgaaattcgtggaaaatgtactaccctgtctttcttcctttctttctttctctctttctctctctctctctttctttctttcaatgaagtctcgctcttgtcgcccaggctggagtacaatggcacaatctcggctcactgcaacctccatctcctgggttcaagtgattctcctgcctcaacctcctgagtagctgggattacaggcacctgccaccatgcccagctaatttttgtatttttagtagagatgaggtttcatcatgttcaccaggctggtctcgaactcctggccactaccctgtctttcttgttgcttggtatgactccactaccctgctccctctctccccctgcagcgggataatttaggaatcagagagactgaagggttgaggaggatatatattattattatttaggtgcaccggcccagtcaaatttaacatctaaaggactgagccctgaacaaagagtcaggttaccttttaaacattttatcgggtcgggggagatctgtgcagggggaggcatattacagaagcaagaaacaaagacagttattcagttgagacatgcattacattatttcttacttttcaaggaaaaacctgtttttcgactgagtttatctgtctagtgaccttgcagctgcacagctagagaatcagggtcttcacaatgcctgggagacgaggagagataaggttcactagcctcagaaaaacagacagttaatttttaaaggactccacctctttttctttcttagggggaattgggttttttttttttttataactgagtttttgcttacacattctttttattattattattatactttaagttctagggtacatttgcataacgttcaggtttgttacatatgtatacatgtgccatgttggtgtcctgcacccattaactcatcatttacattaggtatacctcccccctcccccccaccccacaacaggtccccgtgtgtgatgttccccatcctgtgtccaagtgttttcattgttcaattctgacctatgagtgagaacatgcagtgtttggttttctgtccttgagatagtttgctcagaatgatggtttccagcttcacccatgtccctacaaaggacatgaattcatccttatggctgcatggtattccatggtgtatatgtgccacattttcttaatccagtctatcattgatggacatttgggttggttccaagtctttgcttttgtgaatggtgccgcgataaacatacgtgtgcatatgtgtttatagcagcatgatttataatcctttgggtatatacccagtaatgggatggctgggtcaaacggtatttctagttctagatcctcgaggaatcaccacactgtcttccacgatggctgaactagtttacagccccaccaacagtgtaaaagtgttcctatttctccacatcctctccagcacctgttgtttcctgactttttaatggttgccattctaactggtctgagatggtgtctcattgtagttttgatttgcatttctctgatggccagtgatgatgagtgttttttcatgtgtctgttggctgcataaatgtcttcttttgagaagtgtctgttcatatccttcacccacttgttgatggggttgcttgatttttttcttgtaaatttgttttaagttctttgtagattctggatattagccttttgtcagaggggtagattgcaaaaattttctcccattctgtaggttgcctgttcactctgatggtagtttcacattctttaatttcttttaattcctgtttcaccccagcactcctgtagccccttctgtgccagaggtcagagtgtccaggtctgtgtccagatcaccctgcctcatcttcattatatacttagcacaaaacagagcacattgggtgcataatgaatccacactaggccttggcttccttttaagcatgaggatttttggtgtatcctaatttacggttcaaccttcctgtttccacttgcttcattgttcactttgggaaggcttattctttgcttcgttaacccattctaatcctgtgtcttcttactttgtcctttgtaaacctgcttctttctcttcatctcttttcttggtcagagacacccagaaaattgttcctgaccaagtgaagtgagttgccttattagatcccatttgagtcaccttatacattaaaaaacattttaaacaatgaaaaccacatttgtgcacatagtttaccttgtttatttccttaaacatgcttacaacacaatttggacgtaaacagggaaatttacagttattctttgcagtttcctagtgaatgattattttttagacagacacttaagagcctactaagtatcaagtgtttcacaggtttcatttaatctttactattctgggaaagttttcatttctttgttttacagatgagtagactcaaactcaaggaattagatatgatatccaaggtcatctagatttccaggctctgtctgctggatcacatttgcttttgtacttttaactatgactggaatatataattttataatccatgtgtaacaacactgcctgtgtgtggttttttttcttttttttttttgggtggcctcattaatgcagtaatgttctcttgtttgaagttgtaagtttctaagaaaacaaggtagcagtgcgaaattggacaatgtctggaacttccttcctctgcctttattcttgttgttccattaggtatcagttgtagtgattatagcccaagccatagtaactttcttaaactagaggctcctgaaaatatttcaaagagtttttttaaaaatctgtaagctgcagttgagcagttacaaacttttttatttcctactagattgattgcagtagtcataacattattgctgtcttctaagggctctttaacataatgcttatttactgaaatgtgttttgtagcttcatcagcaattgaagtggttgatatgtggactctgcaggttatataaccttcctaagcacctggatgttgagatgccagatcaaccactacccatgggtcagctaaagtaaaaattctctagtgttcaagagctaaaataaattgtctcaaacaaaagtcaaactaggatgattttttaaaaattattcaacttatttagaagttagtttttctgtacctgttaaattgtttgttctgttttagatactaaaaataaccttttcattctttggagctgctggtatttagtatggcaggcaaacaattgcccttttccctaacagcagctttttgttgtgaatattcctggtgtccataaatgttcttgcttttttcattgcttgtctttgctcattgacttgcctttacctagaaatgccgtctccttaagtctgtctgtgcttcttaaggacttgcccaaatgttatctcctgcaagcaacagaaatctccactagctcaccactacccctaacttcttcctggatttacctatttaggcatcagctattgactttttagtataatatgtgagaatttagctcttataccacccactttcccttcctctttagtcatataagtaatcactaattatcattaggactttgtaaagccaagttttgtagaatatttaggataggatatttctttccttggtgttgctttttgttttgcagtgtcttcctcataacagtaatttttaatttaaaaaattctgttgtagccctttctgtgagatctccttctcttccaaagcctttggctcctctgtgcccattttggcaggttgttcttcgggttggctgtgcacatgtcatcttgaggtttttctcatctgctcgcctagagtacatccattgtttcctggatcccatgtcatcttctttggctttccctttgtcattttacctgactatgtcctcaagtaaaaccctaagaaagcatggagtggtatattttctgatctctagcttctgaaaaaatacaatccagtgtttgggttttggagccagtctgagataggtttgaatcttggttctactacttattagctgtatgcccttgggcagattccctaattgctctatgcatcaatttccatttgcaaaatgggggaaccagtaatagtattagtacctatgtttctagggagctgtgaggattaaatgagttggtacatgtaaaccatttagaacagtgcctggtgcttagcccatccccatcactattcacttttgtcatagtctaccctcacacttgattgatagtttggttgattatgtatttctaggttgaggataattttaccttagaatttcaaagtctgtgctgttgtcttctaaccagtcatggtggtgaggcctcatgtcaccctgagtttcactcattcatgcatgactttctctctggaagcttttaggagtttgtcttttccttggtgagctgaaatagcacaacattgtacttagtgtgtgtcttttttcattcactgtgctgggtacaccaaatggataggcctatggatcgtctctttcaaagttggaatcttgaatcttgtcatatttttgttaactttctcctttccattttatttgttcattttgaagtgtctgttaattggattttagtcctcttgtttgagtcttgtatctcacgtcatttctaattttttttaaattttaagttctggaatatttttcttattttttgacttttaggaaattttatttggacagtcataactttaagttttgttttggttatttattgttgcttaaccaattttcccaaaacttaatggcataaaactacacatttgtctatctgtcactactgtatgggctaactgggggtagctggacagtttttctgctggtctcatttggcatctctcactgtgcggttagacggtgtcagagactggtcatctggatgctcagctgcagtggaatgtctgagacggctgcttcacccacaggtctgctgccttggtgtttcttcttgtggccttctcctctgcatagcgtctcatcctctcaggcctctttgtgtggtttctctttctccaagaggatagtcagtacttattttggctactagaagcacagaagtggagctgccaggtgttcttaaggcttagacctggaacaggtccagtgtcatttctaccaaattctataggttaaagtgagtcttgaggccaacccagattcactgtgggatgggcctgtccagggacatgataacaggaggttaggctcattggggaccaactcccaagatgaaccctgagttctaagaactttttcttctctgattattccatattcatattctaattttgttttattcatgtaatatattcacaagtgtccttatgaagtgattttgatgctcttttgtcttctccctagcatctctttgttctttaataaatttttttcttagtttattttggtcttatttttctttttaaaacctttccttaaatatctattctatgttgcttatcatttgtagtctttttttttttttttgagacggagtttcgctcttgttgcccaggatggagtgcgatggcgtgatcttggctcaccgcaacctttgcctcctggggtcaagcgattctcctgcctcagcctcctgagtagctgggattacaggcatgtgccaccacacctggctaatttttgtatttttagtacagaaggggtttctccatgttggtcaggctggtttcgaattcctgacctcaggtgatccacccacctcggcctcccaaagtgctgggattaaaggcgtgagccactgtgcctggcctgtattcttttttttttttaaattcccttttttgttcattcatatttgagagaggtactgaaagactgggaggctgggtgtggtggctcacacctacaatctcagtgctttcggagattgacgtgggaggatcacttgagcccaggagctcaagagtagtttgggcaatattatgagaccccatctttacaaaaaataaattaaaaaaaaaaaagccaggtgtggtgacacccacctgtagtcccagctacttgggaggctgaggcaggaggatcgcttgagcccaggatgttgaggctaaagtgagttgtgatcatgctgctgcattcctgcattccagcctgggtgaaagagcaagatcctttctcaaataaataaataaataaataaaataaatacaaataaaaaaataaagaattgattgggagttctgcatggcgaagacttggcaactgatagcttttaggggggaatgtatgctgattcctaattgttatcctctacccctctatcttatctcccagtgcaatcataaatgatggctggaactactccattcctctggaggtgaaatctacattctcttgtctgaggtagatatgtttgcttgggttctgcttaaggagatggaggagagcagtgtgtttcagggcctggaaaaggtgttctctatataggcttttggttaatctctgttttcagtcttgcctgtcagtcccactctcgggggtacctggtgtctgagtctagaacctttccaggttgctgtgggacaaattagcttccttgtttttggtatcccccaacctccacttttgtttgcttgctccattaattaaccattttccatttactgtcattttctaatggaggtgaattctcttctgtgggtaaccccatttcttttttttgtaattgtttgtttatatattgtttattcttcactgtatttctagtggagcctcaggacaaagagcagatggtggaaatatgtgttcagtgttcagtttttttctgtaagacatctgcaacttgtgtttttcactgaatatcacgtggacttaatgcatatagagctaccttgtttttcttgattgtgcctacaattctatggagaaatataatttgtgaattacctgatgaaattttcctaattttgaatcatccttgcattcctataataaacactgttagaatggctatggtaatattttatttttgcatttttacttctttataaaataagattatagttttgtttgtttcttttaaggctcttatttcagtatcaagggtatgcagggctaactcgggaagctttacatcttttttctaagacctaggatgtagatctagtttacacagtaattttcaactgcaggaatattttgcctcccatgggacatttggaaatatctggagacatttttgtggtcacaactggtcacggtcgggaggtcttattggcattccgtgggtagaggggatgttactaaatgtcccacaacacaccaggagaaccctcacaaagaattgtctggcccaagatatcaatattgctgaggctgacaaaccctggtttaaataaatgtccaatttggaggatgagtctgtctttttccttcttctgcgtattggtctccagattttccatttcttcagttagttttcgtaactgtagattcttaaaagaaatgaacacttctcccatacttctaaggtgttgtaaagatgtgtaaagttttcactttttgcatcatattcacatgtggctatatgcccttttgtcttcaaagttttctttatcttgatcacttatcagaggcgtgactgttttattatcttagtcttttgaaagaatcctcccttagttttattttttaaatttagtgggttgttttcacattttccttgtgtcttaattatttcccctttttgtttattttgctttttctagtttagtggatcaatgtaatttaaactgctttttaaacaaacctgtaatggtatacattttctttgggtgctgtttgactttattgcacaagttttaaaatctattttctaaatagtttgtattttccaagtcattttattgcatcctctgttcacattgctcttactattaaaactttttatttgcccggcatggtggcttatgcctgtaatcccagcactttgggaggccaaggcaggtgaatgacctgagattgggagttcgagaccagcctgatcaacatggagagagcccgtctctactaaaagtacaaaaattagctgggcatggtggtgcatgcctgtaatcccagctacttgggaggctgaggcaggagaatcgcttgaacccaggagacagaggttgcagtgagctgagatcacgccactgcactccagcctgggcaacaagagtgaaattccacctcaaaaaaaaaaaaaaaaaaaaaaagacatgtattgaaattatgtaaaacataagcttagtgtaacatatagttagagcgagtacttgggaactaatacctagccagcaccaaggtgaagagaaggcacattgcttgcactacagaaaccttctgcaggctgcttcctgatcaccatgcctctgtacgctcatcttgccttatatttctctagtgttatcactcatatatgcatccttcaacaatacggtgtagtgttgcctattgtttgaacttttgaaaatcatactatatgtattttttcatatctttgttgtgctcaacattgtgtgtgaaatttgttcccattgtgtgtagttatagttcttttgcattgctgtatttactccattgtttgaatataccataccatttatccccttgactagatacagacatgtgggttgtttccagtgttattaggaacagtgattgctgctgtggtcattcttgtctgtatttcatggtatccttgtgccagcatttctctggggcacatacttaggagttggatgactgaggcatgaggatcaatttcttcttttacccaagagttatctagaaaaaaaaagcattttcaggtggcttttgaggtgtttttagtgcatcagtgtggtcagagaatatggcctgtgacctttcagcgagattatcagcaatcatttagacttcactattggtgttactgttgcctttgcttattgctacttcttgtatcatgtctcctgctccctgcccctcgagtatatccctgaataatatcctgggtttttgtttttttttttttcctagaaagggtttgtggggatgtgtatggagtgtgttccatgaacttgctgtctgttatcatttgttcaacaaatatttgactctgtataaagtactccatccatatcagtgtggagaatccagaggcaaacatacacagatacgcttcctgtcttgacggagctagatatagaattctgaggtcataattgagtttctttccaggtctttatacttttatgttctgatatttattgttgtagatgaaaagtctgatgcctatctgattcttagttctttctgatagttagtatgattttctgtgtaactgtaaagtgtgggggttttacttctttttttttttttgagacaagaatctcgctctgtcagccaggctggagtgcagtggtgcgatcttggatcactgcaacctccacctctcaggttcaaatgatactcccgcctcagcctcctgagtagctgggactacaggcatgtaccaccatgcccaactaaattttgtattattagtagagatagggtttcaccatgttagccaggatggtctcgatctgctgacctcgtgatccacccgccttgatctctcaaagtgctggaattacagatgtgagccaccttaatgttttgctgagtcacgtcattgtgtcctggcccttctgcaactggtgtgttgttttgttttgttttttttggtttagaggtcttatttttacctcctagaattgtcttttgcatagtaatctgttttgtattttgtggatacagtatcttctcaattactgctaaagattccaattaggttttaaaattctgcttatttccttcattagcagtgcttcaggtcattcgtgcttctttgacttggcaccttcctttcaggttgctaattttcttcaactctctgataatacatggttatctgttcatttatagatgaggtatacctttgatcagtatgagttgttatgagtgtcttcagaattgttactcttttctgctgtggcctccccctcctggtttgcagacctgtgctcttcctgtggcatgagggtggggaggtgctggccagtgagctttccagattttgagctaaaaggaagaggcagagtctgttataagattttgctgctgcattgagttatattaaaaaaacattctgtcttttctctctggttttgtcactgatagagaccatcaagacaggcttcctattaccagagtgatccttaccaactatagttgggacaagtacagtgaggaatgatccttcaaacagaagtggcccctccattatttggattgtgtttgtggctttctcgcgcccagcagtctgattccatctgctttgtatcttctagcatgtccttatagttttggttcactaagggtattctttttgtatttgttgttttgctgctgctgcagctgacttactctcttttataaaattctgtcatttcagtggggttttagaaagaggaccaggtcacatcttgaaatgaaattaatcttaggatttcacagccctaactcactttttgttttgattaaattacttcccctttttgacgggataggggctcagctttctcatgtgtaaaatgaaggctagtaactgggctagtggtgacagacccagatgcatgtgagaatcacctcagagagattttgcaaaagagattctttgggtaggctttgaaattagcatttcaaaaatgctctttcaaccattgatgcaaccaaattttttgggactttgaggctaggtatatattctttagatacccagaataattggctttggaatataagaatttagggaaatgaagaaggggtgaattacattttggaagcttctgcttagatactgctgagacctttgttggtcttgatttctggatcctagtttctagatcttttacatattctgagttctaatctgaactggcctttatggttaaagctgcatatatatactgtgtcctggccaggaagcttgtcttttgacctttgcccgaactgggtacgaaagcccctcctaaaaattcattagattcatttctgaacttgataattgtaatttgtgttaattggtaaattgtgtcttgtagagagatattcgatagtaaattacatgtttttaaaaagacaatttgctttatagtgaggtggtaatcaattcataactcttagttttggggagcgtctattgtaagtaacacatctgacctcttaaaatgtaaggaaattgaatttatgtaatgattcaggcttttcaaagttaaaaaggtagctgttttgaggaactgatagtttggaatatttattttaaacaaaataagcctttgatcttatgcacatagccgtacaagtaaaatgttttcttattttaaattagattatgttttagaatttttttcagttttgctttatatttgactgattgcttttctttattcctaaggcatccattaagttgaattgttcaaaattgtttcatttttaaaagctgagaactgttgtttgtcaaatcaaagttggatttaaaaatgcatattttaattttaataagctctttggtagtgggactgcagtgacagatggttgggagtttgtccctaaagctgtgacaccaatcttctaatgtgcatatttgttctgtgtagttctggcagattctttctctatttcagaatgggacaacagaagaagtgacttcaaaagaagacgaagaggaagagatggatgaagtgggtattttatataagaataacattatggccaggcgaggtgactcatgcctgtaaccccagcactatgggaggccatggtgggtggatcacctgaggacaggagtttgagaccagcctggccaacatggcgaaactctgtctctattaaaagtacaaaaattagccgggcatggtggtaggcacatgtaatctcagctactccggaggctgaggcaggagaattgcttgaatccaggaggtggaggttgcagtgagccaagatcgtgccactgcactcctgcctgagtgacgagcaagactcttgtctcaaaaaaaaaaccaaaaaaaatcataaaatatcttcagttttggacatttgagtaattctctaatctcctttataaataactattaatatggaataattgaaagcacgtcgtatttggaatggaatgtaatttataaattctggctttacctctaactcatgatatgccttcgggcaaattgttttatctgaattcttggatttgattttctggaaaacaaaagctcttaacttttagcactaaaattatatttaatactaatcagtacttaacctgtatttggttattttttggaagagaaactactgagtttaaaaaattttatgtttgcataaaaggagaatttcagaatattttagagactacttgccagaagtagtgaaactgtctcttgctgaaaaatcattcaaagaaatttgtcttagtctgttttatagtattgtaacagaataacagagagtgagtaatttatgaagaacagtcatttattttctgacagttctggagtctgggaaatccaagatgaaaatatcaacatttggtgtctcaggaccttcttgtttcatcctcacatggtagcaggcagaagggcaggagagcaagctagtccaatgtgtgaagcctcattcataagggccttaatcccatgaaggagaaaggagccctcttggcctaatcatctcttaaaagtcctacctcttaatatcatcacattggcaacacttgaattttggagggaatacattcaaacagtagcaaatttagtagagcaaattccaaagacattgagcctaggccagctgtcagtcatgggtataattttagatgttttcaggctctgaagctttgcacttaaatttgaacttcagaacaaagatctgtgtctctgcattgaccaaatagaatgtatgtgaattccatggtgttgattgttttaaaagatttttttctgtttggggtcttataattaatttaggctttcattttcttggtttggaaattattaatctaaaatgtactttagagtgcttcggaactaaaaaggtagtgttgtaggcttgtttttgtttgttttttgagacagggtttcactgtcacccaggctggagtgcagtagcgccggcatggctcactgtaaccttgaactcctgggttcaagcgatcctcctgagtagctgggactacaggccggtgccccacgtccagctaatttttttttatttttttgtagagtttgagtctcactctgttgcccaggctggtcttgaactcctggcctcaagtgatccaccacctcggcctcccaaagtgctgggattacaggtgtgtgccactgtgcctggctgtaggcttgttttatgagtctgggagtaaaatacttcttaaaattgtccaattaggatgagagtctgttttaatgtttttatgcagtttagcttaggtggaataaactgcatgaaaacattaaaccttttccatgggtcaggcagccattgtactaaagttcatgaaccctttcattttcccttgacaagataataaacaagggaccgcaactttgagggaaatctagaaaggtaggagactggactttggagttgtcagattaggacaggtgaaaagcagatattctaggctcctaaaataatgtgggaacaggcccagagcaactttggacatggtgtgtttgggtgcattggatgcttttgagaaggaaggttgatgtgttgaagtcatggaaagcaagattgtccagaaaagacagatggacagaagtcttgaatttgagacaggcatgtttctatttggtatgtttgttgataagaaggccttaagcagggaatggtgtgctgagaatattgttttagaaagatatgttgaattctgtttgggatgtgctgattaatacttaggtggagaagttttgtggatgggaacatgactgaggttgaaggtacaggtggaaatacaggccaaaggcatttgtgagcattgtgggaaaacaagtgtgggtggaagatcagggctgaaaggtgcacacagggagaagggagctccatgaagtacatgggcagagtttgagtgaaggtagtcagtaatctggtctagaaattggtgaattaagcggcttgggaaaaaagtcgagataaatataaactacccctttagagattttggcaattgaagtagaaatataaggtaattgaaaaaagttaggatttaaacaattctgcatatatttgcgtatgtgtaagaacagatagtatgggaagggagggagcagaatgatgtgaataaagatgttgttctgcagggtattattcaaattcttttgaaattattattagtatttgagatagggtcactatcacccagggtggagtgcagtggcatgatcatagcttactgcagcctcgaactcctgggaccaaacagtgcttctatttcagcctcctgagcacctgacatcaaattctttttctaacttatttttaagttattaacatcaataggtgcttactacataaaaccataaacttggaaatcaggggaaagcaccaaatgtctccagagataacaactaaaattaattgaaattaacatttcaatgtaagttgttctggtctttttctgtgcttatttcagcataattgaaattctctctattcctttgtgtaatccatttttcatttcaaagtttttcgatacaggagaaattatgccgtgttgatatttcagtggctgcttaatagttcatggaattgagttaactgttttgctatttttgcacatgcagattttgtgtttgtttttgtggttgcaaggttgaaataggtattcttatgcctaaatttgtgtttacctcttagactagtttcttgtaatacaattctagaagtcgagtttctggaacaaactatgaacagttaaggttcttgacacctgctgctaaactgtttcaaaggttcctcttaggagatttaaaagatggcttggccaggcgtggtgtctcacgctggtaatcccagcactttgggaggctgaggtgggcagatcacttgacgtcataagtttgagaccagcctggccaacatgttgaaaccctgtctctactaaaaatacaaagaaattagctgggcgtggtggtgtacgtctgtaatcccagctactcaggagactgaggcatgagaatcacttgaacctgggaggcagaggttgcagtgagcagagatcgcgccactctactcctgcctgagtgacagagtgagactctatcttacaaaaataaaataaaataaataaagaagtaaataaataaatgatggcttatttcataatagttgtgactttgtaaagcttttaaatctgctttccccagagtctagcttttaaataaaatacaggatataaaaggtgggagcctcttgaatggaatgtgggggctttttctttctccccataggatagatatattctgtttcctgtcccccaccaagtcaagaataatttaagttttggcataagaaactgctgaaggaaaatgggttgaatcggctaatatttttcttctttttgcaggatatagaagacttagatcactatgagatgaaagaagagcctattagtgagaagaagttggaggatgaaggaactgaaaaagaaaattgggcaatattagagaaaattaggaagactgaaaggcaaggccatttaaatgtgtaagtgtgtataaatatctggactttttggttaagtaattatagttaataccaggcaattcatgaacatgccgatgtcagctgctctcctcctccattcctgccttagtggcggattcagtcatgtgtttattggttttgagacagggtcttgctctgtcgcctgggctagagagcagtagcacaatcatagttcactgtagcctttatctcccaggctgcagtggtcctcctacctcagcctcccaagtgtctcagattatagtcatgtgccaccacaccaggctaatttttttgatttttagtaaagatgaggtctcactgtgttgaccatgctggtcttgaacacctgagttcaagcagtcctgctaccttggcctgcccaagtgctgggattacagacatgagccaccatgcctagccacgctcatatgctttgttgccgaaggttatctttctcatctatgaatagccacgttttaccctgttcatctgctcttcacatcctggaaccacctgctgatccctgtatatgcccctttccagcttgtctatgctgtgttctctgcttaccttctttctgtggcatctgtaaattcaagttcattctttcctacaaaacacaactcaaattatttctccttcatgaagctgactttgacccatcctgctctgaccaaaccaaaagtaatgtttctcttttgacttaacatctcttttatgtgaagcggcaggatgggaaaggaacactgagtttggtgacagacacaccttttatggtttcactttgctcaaccctaaaatatggagagacagtacatatcttttggatggttgctatgaaaaataaattaaaatgatgcatgtatatacataaaatgcttagacagagtagggaaacatcaaatgattgtctgaacagttactgcttcctgccttgtattagagctatttaccaactccacaacatccgaggaccagttactttgtcttgggcacaggttctccaaaacagggaatgaattgttaggcaagcaaatgccagatgttgaaatcagataactctccctccttcaatcttatttgtatattaatttaattggtaatttttcatacagcaaagaaatttagttaatctccatatcttgattatttaaaaaactaagattgtagcatttgaattaatgttactgtacttcctgtgtcttgtgatcaattccagtttgagttatcttcaaaacaagtaaaaattataattttgcatgaccgatactatactaaatactttatactaataaagatcttttcatttagtcatcatagccactgtgtgaaataggtgctgtttatactttagagatatgaaaaacttttcatattttatagatatgaaatgagttcaggtttacatagctaggaggtaatatttttataaacttgatttttttcccccttcaaagtctagtgcagtctttaaaacctctagtttcacatgaccaaaaagtagttccatttctgtttagtcttaggataagatatggatgtgttttcatctttagagaagtccctgcactgaaaaactgaaaccagttgcatgtaggcacacgtggttctcagtgtcttaatgtgtgaactagaccatctgtgtaatattcttgcttgtagtcttatgaatggaagcctattttacttaatattgtgtcaccttgagtattttcaaaaattgctggggtttggaatagactcatactgaattctatgctatcgtggagtccatggttatctgaacatgttggctagagttttttaggtgataagaaaaaggaaatgaaccagacttgtgtctagttttatattctcttgaaacttcataacgcttcatttaattgtcttttttttttttttttttttttacttcttaaattgttgagtggtgatccatttttattgtaatctttctcttttttcttttttttttcttttgagatggagtcttgctctgtggcccaggccagagttcagtggcaccatctcagctcactactacctccacctcccaggttcaagtgattatcttgcctcaacttcccgagtagctgggactacaggcacatgcaaccatgcccggccaacttttgtattttttaaatcagagatggggtttcatgctgatgaccaggctggtttcaaactcttggcctcaagtgatccacctgcctcggcctcccaaagtgctgggattataggtgtgaaccactgtgcctggctactgtaatcttttagagcaggttgaaataccttaaatctttaaattagttggctcagtagaccctggtaaacagcggcttttgtgtttccggctgaagtgtctgggtcagtgcaagcttgcaagcttcagatagacttatacatatacagggctcagggacatatacagatcacagagttataagacaggtaaggatctctaaatcccttctcttattgttcttttgttcttttctgttgtcagattataaatgtcatttcttaaagctggacagaaatggaaatgtttactagctttattttgtgaaactcaaatgcaatcaagttccaaaagatgtagggggtaagataggatgagtttgcttgtttttggatttaaagaaattgtttttataggtccgttggaatttttttggtcatcctcctgatagagtgaacatttacatgatttttatcttctggcaaaaagcttgagcaatattgcttgataagtaaataagagtaatacatttcattatacagagaatgattgccaagttgatttttgtgatttttccccccagttttgaaagcaacataatcaactcttattgtggaggtagttatgttattactttaaaaatatataggtggagtacacctgttgtcctagctactagaggtggtgggaagctgaggcaggaagatcttttgagcttggggaagtcaaggctgcagtgagctgtgattgcaccattatattccagcctgggtgacagagtgagacaccctgtatcataaaacaaaaacaagggggagtggagggtgggatacatattgtatatgtatatataggacagttgtagaaaaataccgattttttagtgatttaacttttgacggttccgtccatggcaaatttttctccttgaacaccttggctaataatacaagtttaggaaagcatattaaactgtgtttgaattcttgagaaaattatatacatatgactgttttcctttagaatgactccaaactctgaacccccttattagattagatttagggtattgtgatccctttgggacatttattctaaaggagctggaaactatagtggcctctatttttcctggggatatagagcagcttaagatctcctctttctggaacttatcctaggtgctctattttagctttcagattggttcatttttgagttagttaaaataataataataataataatctttttgtttgaattgttttttgttttggaattctcaaggttgaccctgatagtcctttgcacagtgatctttagatcttaaaaagaagcgataggagacattttgcttatctttcaaggtaagaaaatggttatgagactctatatccttctaatgggggtgtgtatttgtacaagtgttttggaaaacggtttgggaaagtggaagatactcacaccctatggttcaggaatctcgtggatatatactccacaagaaatgagtacataggtgccaggagacacaggaatgttcagagcagcatcgtttataatagccccaaacagaaaataacccaaatgttcattccaataaaatggagaattgtggtattcataaaatggcttacagtcatgtgggacaagatgagcgaatcttgaacactatgttaagcaaaagagaccagacccccaaaacctattttgtacaatttcctctatatagagttcaaaaataggcaaaactaatgttggttagggcatacattcttagcggaggcaatatcgcctgcagtggagtgaaaattggtccttagagtgaaagaaaatctgacctattatactggtctgctgccctccaaacggccatagaacataaatgaaaagaaaactgagaaacacttctttatgggttcatacttgggcagtaaaactatcaagaaaaaagaggtgattagacacagggtagagtaaggagtccatctaggtgggaggtagggaggtgtgaactgaaaggtacatctgtgggcttcttggatactggctgtaatatatttctggaccaggttggtggttacatgggcaaataatttaaaataacttgttaaggtctaccttaaggtatcttttgtgtacttttctgaatgtgttatatttaataaagtacttttaagataccaaaaataaaggttacaaaagaataacaatggaatctagaaaaaatgttaatgatctaatatggaatctagacaagatgtaatggcttaaaatctatggctatatgaagtattttgatgaaaaaaacaaagacataaaggaatactttgttgtacttactctaaggatggtagtagttttctaaaagcttacttagctttttcatgtgtatatttttccttggggatatatcttatgattgaactttcttgaaatgaccctaatgttagtattttctctcaattttgttatcatagaaactgttgtggttgtcaactgggttgtcttcctaaagtatgaatccagtataggctgaagttgctaatggctacttctttacggattcatatgggtgaacgaatgaagcactcaggcctacaacaaaaaaaacacacacacacaaaaaacaggaagataccatttttaaaaaaaaacattaaatcatatgaacatatgcacaacaccaaactttaaagaaatagaacctttggctgggcatggtggctcacgcctgtaatcccagcacttgggaggccaaggcaggtggatcacctgaggacaggagtttgagaccagcccagccaagatggtgaaaccccatctctactaaaaatacaaaaattagccaggcgtggtggcaggtgcctgtaatcccagctacttgggaggctgaggtgggagaatcacttgaacctaggaggcagaggttgcagtgagccaagattgcaccattgcactcaacagcctgggtgactagagtgaaactccatctcaaaaaataaaaataaaaaagaaatagaaccttatcagtacctgtagcaccctctgtgcccctcccttgtcatgtcctctttgggaggtatcttgaagggaatgtgacatcttggccaggaaactggaggatttgtgactgcaggtggtgttttcattattttttcctgctgtagttagaacttcagggaggggatgatctgggaggtaaatggctgaaatgctattggatttgtgtttgtggcccatggctcctgataccagaaagaagggccttttctggggttggagtatttcttaagaggcctgggaagaatgtgattgccttgagctaactgaccttctgaagaggaccttaaactgaattgccaagttattagtattgggattcacagactttggagaatagcaggtatgactcagaaagatttacaggaaagagccagaacaatatgtttatggcctctgatgtccgcagtgacaacttgagagtcgtgaataataagcaaaattgaacttgagataaagtataacacaaagatgggagtgactgcaggagggaatgtgccctggtcagcaacttggtaaatccaacttgctgtacttttaaggaagtcgttttcagatgttacaggcaacatcagagttactgaattgaattctgaggtagtactttaagaaaggtctacttagataaggttaggttcatttagagaataatagccaggattgggaagagattcttttccatgtcctaggatagctggtgaaattatggatttggagaggaaaacatgggggttctggttcatgatagattgtcttcaactatttgaaggagtatgtatatggaagcattagtttttatttgtttttggtgaagacagggcataaaactagaactaataagtcaaattacaaagaggtgattttcaactcaatgtaaggaagtgacttgtaactatttagacccatctggtgatgtagtctttgaaaactagaatgttcttcatctttaagaataacttagaaggctgagatgttaaatgggaagtcagataacttcatgagatccttgtagagcctgagagtctcgttctgagttaaaatatactaaggtaactcaaacttaattttaccagtcaccctcaacctttattttcccctccctgaagaactctttttatttctgtaaaatcttgattcctgagttccagggtacagagcttatggaatagagtccccaggttttgatgtaggatcctctttctcctgtctgaaaatatcctttagtatttcccttagtgtgagtctgcagatagaaaaaatccttattttttatttcattattaaagagtatcttcattgagcgtaagtctctagattggcagtttccatctttcagcaccttgcagatatcattctgttatgctagcttccattgtttctcctgaagtgtttatggtggttaaatcttgtggagtctttgatcagttctggaaaattctccacaaccatatcttcagctcttgcttctgtcccattcttttttttcttacagggctctacatatatgataaacttttcaatatattgtcttattttctcaattttctacctttttgtctttctgacctttttccggtttactgaatctgtcttctgctaggttactgctgtggttaagcttatccattatgttattaatttcagttttggtagttctaaattgcagaatttcatatggttcattttataatttgcatttctctgccaggttttcagtcttgtcctgtctttccttgtctttcagcagagttattttgaagtgtgtctgctaactctgttatctcaatcccttgtggttttgtgtctgttgtttgcttctcttgttttctgttatgtcatctttaagtctcatgtggctttttatttttagtgatagacattatatatgaaaaattgcagagctaatttgaagccttggatgatattcttctccagagaggatttacatttcccctgctagggtcttggaaattcacaatcagggattgagacgattaaagctggccatcattccctgttggggcattttgcagtttgttcttcagattcccaacctaaggagtgggagacttagcagggcctctcctcagtggatgctgagctccaatgtttaactccctgtgagctctgtgaggctgtgagttctagctcagcttgttaacctcttcttctctgctgtcattggaagaaaacccaagggggagaaaagaagaccctgttctctgctattcccttttctcagccctgtaatcattacattttgtccatctttctagttctcagtgagaggattgatctaagttacctactctatcattattggaatggttcctttatatagttctagtgaagtgaaaccccttcatatgtttcataagtttaccataacactgttctgtttgggcctcattttaacttcatttttatttgctttggttttcatttcattttttctgtactaattttacttttatgactctcacccattatctgataataaatgtacatattcttttatagacttttaaaatcttctaaatggtatatagtattaacgatgttcttaaaattaattaaacttgcttatttgctttttaggataactttccatttgagcctccatttgtttgagtggtattacctgttctctcaggagcataagtttaagtgattactttaaatgtttttttttttttttttttttttttagtttaaaaaaattttttgtagagatgaggtctcactatgttgctctggctgttcttgaactcctgggctcaagtgatcctcccaccttgccctcccaaggtgctgggatgacaggcatgagctgctgtgcctgggctacgtttttttttttaatatcgcgtgcaccagaatcatttggagagctagtcccagggtttctgattaagtaggcctgtggtgttgcctgagcatttacgtttttaagaagttcccaggtgaaactgatactgttgttctggggcctacatctggaaccactggttataaagcattatgttgttgataggtagagattttagtgttatatatatgcatatatacacatatatacacacacacacatatttatacatacacacacacatatatatattcatacatacttttttatcataaaaaccaaaggtttttcaaatgtaaattgtgattgaaggtttagagaatgttatgattacagagtggtccccccacatacctgtaatcctaattagtacttctaggaataatcatgggaaatcccatggacctatggagctggctaattacttctagaggtgatagttgcagtgtagtagaatcaaatggtaattgtcatgcagttttactgaaatttgtattgcttcttttttgtgattggaagtcttacagaagtggggaaaagatcacagtttgctaggttagttatgaaatgttctgtagaccctcaaagtatgagcaatttaaagtaacttgaggattttcaaacactcagctgactaattccattatgtgacataatccacattatggtgattaaaatctaaatatctccagcccttactttgatcatttctatggttgagatagtaatagttgcatttagggtaaaaatatgagtgactacttcacacttcagaactttctccagaagagctttgttgctacagttatttttagttgtatttgctttacatacttatgtatgtgttttgggggctaagatcctgttaagaatcattctgcataatcagaatacatattaactatggtgctgatactacggaatagttgtctggacatgatatccatgtgtaaaagttcagagaaacaagaagtgtgggtttaaaaaaaaaaaaaccttagtattacatgtggatgtgctgagctcattttgagtttccccacacagtaaaggaatattggttttattatttaattacttaattttattgagacagggtctttgtctgttgccccaggctggagtgagtggtgcaatcacagctcactgcaacctctgcctcccgggctcaagccatcctgccacctcagcctcctgagaagctgggactgcaggcatatgccagcacaccaagctaatttttgtatttttgatagagacagggtttcaccatgttgctcatgttggtctcgaactcccaggctaaagcgatccaccccactgagactgacaaagtattaggattatgggtctgagccactttgcccagcccaatgttgtttgttaaaattttttatttatttacttatcttttgcttttctgttttaatttttaaatttctattttttcaatattgtgttttaagagtctacttacccgacgcctgcagtctaatctttgccatatcttcccaaatgttctgtgagtgctaatatagtggtatggtaatagatatttgttttgtggagattgcaaggttttggggaaccaggttcaaaatgtcttttaccaaaggacttcttggagccttaatgccattttctgtttttcccaaatttgtttattagtgttcctgacagcatctcagaggatggtgtcctctggcttactctctgggaaatgctgctctgttggaaatccggagttctgagtgatccccatgcgttttctgctgcagagcaggacatgctgaagtgattccttcgtgagcagatgttagaggtctccctttgacagcttgttacaaagttgatcacgaatatactattacggtgagtggaagtcccaggttgggtgtgaagcagagttgtttagaattgtgtactattttgttacctttaaagcttctctaggctgttttggttttggcagtaaaattgctataaaaagtacttctcttggcatacaacctaatggtcagttttggaagttcagtgttaagtaacccagccaaatacttacgtatacaaaataaacacaagactgaaaaatagtaaatgtttaacctttgctcactacagcaggctttttactagccaccaagccatagttcttttgtttttcatagttgaatgttaaaatgtctttttaatgaagcccttactgattggggagaaaggacataagtattgtgctttagttttatgtgctggtttataaaattgtgtatgttgactcaatatccccataagcatagggaaaggaaaacgggtcatgttttgttcagaatcttatttgagaaaaaaaaagatcaaagaaaagatttggataaaaatctgcaaattcaggataaatgtatgaaaacattttaaaatgtgattatgaaatagaccagtatagcttttcaacattttgttgtaagaatcccaagaatgtaagtttatgatcttagtataccacctagaatcgagacaaatacatgaagttatgaatcatgccattttcagttttaaaatctgttacatagtttcttcattgattcttttttgccacagtgtgttatggtcctcattatttggatgaataatttgaataataagtcagcttgtgacttagccaaataaatcttctgattcctagtaaagtgtttttcattatacgaaatgccagctatgtaagaggagattaaaagtactaagaactgtaagtactgcattgattatcatatgctaaccatgggccaggcacggtggcacacacctataatcccagcactttgggaggctgaggcgggtggatcacttgaggtcaggagttcaagaccagcctggccaagatggtgaaacccctgtctctaccaaaaatacaaaaaatttgccagatgtggtggtgcatactggtaatcccagctactcaggaggctgagtcaggagaatcgcttgaactcgggaggcagaggttgcagtgagctgagatcgtgccactgcgctccagcctgggtgacaaagataaactccatctgaacaaaaaagaaaaagaaaagctaagcatggacttaatttctctgagatttaaagctgcaaagagttgctcttcatgaagtagatgggatctcagctgggcagtgaaatgtgagtggggtttggtcagctggtggaggttgcaggaaaattatttacataggtgaagagtaagcgcaatcaggtatctaggaaagaatgaggggttcagagtatacgaaaccaatttgagctataacacaaggagggtaggattcatgtagaagagttgtaggaaatattgctgatgtaatattttgtactcaaacagttctgtggattggtgacagattttttttttcaggtaagtaaactattacccctggatattcatctttctgtgtagctggttgagaaacaggggagtaacagtaaagaaactgttttagaataaatctggtgacagcagaagagaatatgagacacattgtgctcacagagcctagaagagtgtgacagtagttgagggcaccgctgttgtcttagagtgaagtgaggagaacctacattggtgtggtagtcatgggagtggaaggaggaatgaaatgtgaaagcccattggaggcagaatcaaaatgccttggtcttaatagtcaactattaaggagaaattattggctgacttaggaagaagtgaaaaatgtgaaataccaataaaacaccaggcttgtgattttagtcagggtaaagcttaagcattgtgtgattctagatagattactgaggagttttgttccatttattttatgtccatatctttgagctatgattctatcctttatttcttgacatacccaaacattttttaaactattgtgatacagcttttatatgataagtctcactctttgaagtgtacagtttggtggtttttagtatattcagagttatgcagccattaccactacctaatttcagaaccttttcttctccccagaaagaaaccccatgcccattagcagtcactctgtatactcgtctcccccaccgttgatcctggcgacctctgatctaatttctgtctctgtagatttgcctatcctggacatttcatataaatagaatcatacaaaatgtggcattttgtaattgacttttctttgaagtgattataaagcaaatgcctgaagaggccaagcttaggatagtgtttgctgtacagctttgacaactgaattttttttaagttgaaaatattactgtgtctgtatatgtggcatattatccttagatgaccgttacttcaattattagaatttttttccctagtattcttgaactgtctcaatattcagtaggaaccctttggagacaaagagcagtaagaatttggaacacatattgacgaaatgaatgtcatttaatacagtagtagagtcgaccacttttaggtgtcagtgctgctggaagtgtatattaaggaaaagtttacttatcttacttatgtagtgaaggtactagaactacttctgtcttctgtttagatttcaacaaacatttgcataggtattatgcggttgtacaaatgtactgtcttttgacctgaaaatgcaaaaactttcttcctactttctgagactctgcaaccttaaaggaagagtggggtactttaaaggaaaggtggtgttggttggataatgggtgacaatgtctgccatatacttccttttcccaaaacaagttcctgtctaccatcagcatctccaaaatttgaagatcaagtgtggtgttaactcattaactaaatgactagactttgagcagttgtggaaccaaaatctgagtgagtgcctggatgttctaattctgttaaatcaatgagtgcacattatatacaatactctcttagcccagtggcagatttaaggagtgagagagagatttcaaatgtttcagaaatcaaatacacaaagaataaaaatttttaatcccatgattctttacctgagtttaatttttcggagagtttttcttttagattttcttttccttccattaaactttcactttgaaagctcccagggtttgggcaaagcaagtgggaaagacacttgcttggattctccagggcaagggagttaaagagggcttctttccctcattttattattgaataatgtcatgaaaacaattattaaggtgaatggtctacagtagaagtttttagatgccttctctgcaaaataatttggtttagtcaatgcaaggatgcctttggttagctggaatggaagatgcgcaggctagagtggtcttggcaagtcttctggggggaaatacagcatttggaagggtaggaagcagaaggaatctcaagcaagggaaaggtgtgggcagagccccggaggacagaaccgtttgtggtggacttggtgtccacatagatctaatcagtggtcttagcttttgtgctttcaaaattaccacagtttttgttctaaaactatcattcccttgattttactttaggcatgctatctgtgtattttgaaatttaaaataacattaaaggagaaatgaaattattttgtttgagaaagaattaaaaggttaaaacatcttgatctaaataattttctaatgggagatttggtacatccccagaagttgtctttggttcagagaacagtcttcagacctagaaaggacttgaggagtcccagagaggagccacatggtgtgaaccattcgattctcacaacagaatggataagaacaatttcaaccatgaaaccgtgcagatgttcatattttgaatagggtaagatcggtgccattgtcagaggaaaaactcctggccatcacaggttgggagagaaagtttccattgtaaagaacactcaaatgccatttaaggaaatgggttcttctgccctgattctttggaatatttagggccacgtttttagtttttgacatcataaaaatttcaaagtattctgttctgattgccatttcaaacaattgactggaatttcagagcaatttcataagagtaataccattagaatttttaaattacctataatcctatatgcctaacaagtatgttcatgcttacgtgttctcttcttgtctttactgtgtgcatactttcttaataatgccacatggaaattgtttaagcaggaatacttctcaagataattttgtatgtttccttttttctttttaaggtatgtattgggtggaggagcattatgtatggaacctctggtgattattttattattatactcaattttcaccctcaatagagtgttttgattatgtaagttagatcgtaagtagacggttctcttaaagacattttagtgttttttttttttttcgtagctcctactttcaagaatgaaaaaggtatcccagcagtttgggaggctgaggcaggcggatcacgaggtcaagagatcgagaccatcctggctaacacggtgaaaccccgtctctactaaaaaatacaaaaaaaatagccgggcgtgatggcgggtgactgtagtcccagctacccgggaggctgaggcaggagaattgtgtgaacccgggaggcagagcttgcagtgagctgagatggtgccaccgcactccagcctgggtgacagagcaagactccatctcaaaaaaacaaaacaaaacaaaacaaaaaaaacagaatgaaaaaggcaaaccagtaaaataacattgtgcttggtgctgaatttatgctaggataggcgttaacagtgacctttatttaaggttttaatttgttcatgttgggcacttagaacattggtttgttgtttttttgtgagattctggaaacgttccaattttaccttttccccttgactccagactttttaacactggtctgctactgttaagttatatgccatttggttaggccttctcaagtgggaaccaggaacgctgctgtgttctagagatgttttgttcttcctgtagggctgaagcagtgcctactcgatagaatcagtcatcatgcaaataaaagccacctgagtcaaaggcaaagccagagtgcagcttggagcaaagaaggtaattttattaagaattttacataaaccataagatatattttatgctactttgtgagccttcttcctatcttaattctttttgagagaattcatttcattttcatttggtttgttttctttttgttacaaagatgatctatagaacatatagaagtataagaaaattaaagttactaactgataatcacttaatgatttagtatctgattgtttagtctttgttatatttactgtagagaaacatgtctacagttgtaaatttattattgttatgtataccatagtaaaagttatatgtactttgaagttttgcaaaattgagttcatgttataaaattaattcctgatgaacttttatgtgctaggcactagtctttttatttacttatttttactttttttgtttccctctgtgcctatgcttaccaagtctttttattttttactttttattagctctttcagtcctcttaataactttaaaagagggtattattaatatctgcattttatggatgagacaactgaaggtaggtaacttgtccaaagtcacaggtggcagagcaaggattggaaccagacagtctgactgccctaggcccaaccaagaggagctgagagcaagccacggggcagaaggatgttggaggctggttttctgttcagttaacatgaaatgcaggctgtaaccgtaattccaggacattactgagaaagccttccaaagccagaggggttttttttgttttgttttgttttgttttccatgaccatgacttttgagcaaaaatttggttttgtttaaaggcaatatggtgctctaagaaacttccactcacacttatggagggaatggtagttgagctaaatagtgaaatgctgtagcacacagcctttagggcagcttctgacctatttctatggtcaggaaagacacctatctttgcctgctgcccacagcctctagttattcaccttcagaatttcctagtctgtgatcacattcagatgagagatccgttttgttttttccagggtagcaggaagtgagtcaccacctatactaagcagtctagtcttctgtgtataaatgagcaagggtggggagccagatctgagaaccttgtgtaatgctgagatgctccaagagaatccaagaggatgtcaggattatgcatggtggtaaagtggtctcatgttagttgtacccacagctctcatcagaagcagacacagatactttttgtaggaaaacatctctaacttaagcctgtaggattcccaaagattaaaagcaggcaaatatgaattcagtcaaatcatagcattcaagtagtctcaacccaacatatttgagaattgttagaaacaatgaatatgtttcccaaagactaggttttggaattatcagatacagaacacagacttcaaatattagaattgtgagaaaatagttacatgtcaaacctaatataaaagaaagatggactcattaaattgagcaacagaaaggccaccaggaatgaggaggaggacctgaaaagaaaatggatgaactagaacttacagaaataaaatatatagctgggtctggtggctcacacctgtaatcccagcactgtttgggaggccgaggtgggaggatggtatgagcccaggagttggggagacaagcctgggcaacatggtgagaactcgtttctgtaaaaaataccccaacaccaccaaaaaaaaaaaaaaaaaaaaaagtagctgggtatggggcacgtgtctgtagtcccagctagtcaggaggctgaggagggaggatcacttgagctcaggaggcaagggctgcatgtgcatgccactgcagtccagcctgggtgacagagtgagactccgtctcagaataaaatgaaataaagaaataaaaaatgtaattgttgaaataaaaaactcagtggatggattagacatcagaagaaagaattaattggttagacaattatctcccaaaagtgagtcagtatgttacacagagagacatgaggatagatgatagggcagaagttggtggggttgtagggggagggagatcagaatgaggtctaaaatatgtcttagtggaatcccaggaggagatattaaaattatattagaaagtgagagaaatagaagttctaaaggcaatagaaggaagtccacataaatcagtcacaacaaatgtaaatggactaaagttaccagttaggtggaactaataaaagaatatccagctgttttaatccatcatatttaaaatataaggatatgagaagattgaaagtttttataaaggagagagagtaatgaagatatggcagtatacattaaccaaaaacaagtgatggagcttcagtatcaaaaaaggattttggaacagaaagcattagtaagaaacttgatgctgactgttaattaggaggatgtagcaattttcatattttatgtacctgtcaaaatagcctcaaaatgcaggagaaaaactgataaaaccacagggagaaattgacaagtctgccagcatatttggagatttcaccataccctgcttaccataagtaagttacacagaatgcccatatgtagatttgaataaccagtgaatggacatggtgtaatggacaaatataggcctttgtacccaataattagatattctatattcttctcaagcatatgtggactgtgggagaaacattaattatatattaattcgtaaagcaagtcagaagatttaaaaacaattggtaccatccacaccatataatttataatttaaatatgaagcaattaaggttagaaggcaataatgaagagattaacaaaaagctacatgaatttggaaattaaacacccttgtaattcatggtataaaaaactcaatacaattttagaatgcttagaattgaaccatagttaaaatatgaaacttctctctgttcctgtctctctccctctccctctctcttcctatctggaacattcaagaagctaatctttttcaatgaagaacaccccaaatactgaaaagtaggaaaaagacagatggcatttcatggtaatcccttcccccaagagtgtagaatgtttctttagcttctttgatagtttgtttacttatttattaagtacttactataaaccagactctgctttaatttgtgatgaacaacctagagattaagtcctgccctatggattttatattagagtgagaaaaacagatagctaagtctggagctcaggggtgaggcccaggttggaattatagattcacttgaccaaggtgaaacctggtgtgccccctcctacttcacatccccagacatacttctggaacatttctgttctattcttgtgtataaactcttccttttgagcctctctccattaatgcatgtcaacctctacttgtcttttgttgattttgaggccacttgcccatataacttggaggatattgaagaagaatcataccgacctggttctgctacctaccagctgagttactttggtcaagctcttggacttctgaggctgtttcctaatttcaaaagtgggtatatgatgtgttaggccctggtgggttgcaaggaagaggtacacacataccacctttgatgatgagggccgaatgttaacttggatggaaagtcatccaaacagcgatattgtctctggccctagtaatttcaaaacctcacagaatattaatttagcagtatttaggatagggtttgagctctgaagacctacagtatggttatttgttcatatggctgttttccatactagaccatgaactccatgagggcagggtctacagtttcatctttgtctcctaggcactcagttcagtgcctgatacataataatagaggcacaaatgttttaagagttgaggaattttcaactctttctgaaagaataggaagatataaaggcttctcagagacggtattatttaagctgattttgtttttgtttttgagatgaagtcttgctctctcgcccaagatggagtgcaatggcgtgatctcagctcactgcaacctctgcttaccaggttcaagtgattcttctgcctcagtctcctgagtagctgggattacaggcatccaccaccacacccagctattttttgtatttttagtaaagacgaggtttcaccatgttggccaggctagtctcaaactactgatctgaggtgatccgcccaccttggcctcccagagtgctgggattataggcatgagccaccatgcccggcttatttaagctgattctttaagggtaagtagaaattttttccaggtgaataaaaccttgagctattattccaagcagagaccagtaggtgcaaagacacagggatatagagatgttgaagtttaccaaacactgctagattaaaaaaacaaaaaggaaactatcaaaatcaaaaattaaaattaaaaatcacctataatacaagctatgaatgggcttggccagaggtcagatcgcaactgagttaactatgaccgtagacactcagtaatcgatggaagttttagggaaaacacataacattctcaggttgttggcagagtatctggaacaatttacaaatacgggcattgaattctgggaataattacactgtagtgatatcatttccttctctgcgtatgaagcatgtatgtattgcacactgttcaaggtgctgaaaatcagactcttctcgagcaatcaagggagatggatgggtgagcaactgattatcatgtgacaagtgaggtaacagagatatgactaagatggtatctaaacaagaagaaaggaattattcataatatatggagttctggggaaatatttctcaaatgaagccggccgggccggatggctcccacttgtaataccggcactttgggaggtggaagtgggaggatccaggaggatctaggagttcaagaccagcctggtcaacagagcaaagccctgcctgtttctatatttgaaaaaaaataagtaaatttttttaatgaaatgatatttgagcactctggagcaccatacaaatataggacagactgaaggaatgtacctggcttgagttaacatttattgaaattttatattgcaaaaatagtacatattcactgttttgaaactagaaagaattgataggcaaggagggctgtctacaaagcactccatagatccaccatactgagacaatgcttaatgctttgatggatttattgtatactatctatgcatatgcatgtattatatacatacatgtgcatggttaaatagaaatatttctccttggtgttaatccatttattgttatgcagtaaatccccaaagagcacatttgctttgcccaagggagtcttttgctacatactgctgtacataatgaaaactaaaaaattggctaacttttcagccttgtgaccttgtggtgattcaaatagaggcttcatcaaaggcagattcagaaatgaacttggtatgtgggtggttatgcttggcattattgtttgtaatagtatgatagggatgacttcagtgtccaccaacagggaactggttaagtaaactgtggtacatccaaacgatgaatactgtgcggttgtaaagaagaatgacaaagacctctgtactcatgtagaagaactcacatatattgtgtgtgttttaagaggaacaaggaatggtatagtatgtatggtatgctactttttgtgttgagagagaagagtagaataagaatatacgtgtgtatttgcaaacataaattctgaaatgatatataagaaaccaattaaaagtgtttggctgtagaaggagaataagactgtgaatgggatttggccacatacttttataggtagttatatttaaaaattttctgaaccatgtgtttgtacacatgacctttttaaaaataagtgaatgaaggaatgaagtaggattatgagaaagagataagaacaaatgatctaaggggctgcccatctttttagtacccagtgaatattaatatataacaatagcagcaaaaattggaagagtagccccaggagggtagggagtcagcctttcctttgtcttttcctcaatttcatatattaaacaaaataatctgagaacgataaaacaatttgaaataaaaaatgtctccagatctcttaaaaggaagctggggcagctttctgtagcgcacttcccaaaaatgggctgatttacctcaagaggcagggattctagcctacatgggatacatacaggagaaaacaaaatcagaaaaagaaaagagatttaaatataaataaatgaaaataacaattctccctcattataaaggaaatcattctttttgtaataatttggatgacaaatattaagaaaaatctttaatttgccactcaaaacattgtggtttgttgctttttatacgtttttatgcacataaaccttttaaaaagtagaatcgtagtatgtagtcttttgtcacttactatattttgggcatatttctgtggcagtaaatatatcctggcatcatcatttttaatagctggatgtatattaagttaatcactgccaccccagaggtgaattttcttatacacacattttaatgggctcgagcaaacatttttggactgaattcatagaagtagaatttctggaggaaaataatttttagggtttttaatagaaattttcaaatcattctccaggaaaagtgactcaggttatactcccaccaacaaggacagagctccaggttcccctttccatttgtcatctttcctgcctttatacagaaaatctcattgttttcatgacatttctttgatttcttgtgcttttgaatctttgtatatgccattggccatttttattcttgtgagaagtgccagtttctccattgcccattttcggttgaaaatcatttgtttttttttctcagtaattttaaagatttctttatagtctaaggatacaagccttttatctgtcattgaggtgacaaaactttctcccagtaagtaatttgtcatttcattttttcttcttttctttttcctttcctttccctttctttcttttccttgtttctttctttcttcttcttccttccttgctttccttttctttcttgctttccattcttactttcttttcttttccctccctccctccctctctttctttcctctttctttttctttctctctttttctttcttctttccctctctctctttcttcctttcctttctttctctttattccctccctccctccttcttcccttttttttctttctttctttcactagccaagctccaaagtcacatttcacttaatttttatcctgccaaatttgaaagccttttaacttcgtgattttagtgtaaacaggagcaggagaaaatgtaattatctaagtctcgctgtgtcacccagactggagtgcagtgccataatcatagctactgcagccttgaactcctcgcctcaagcaattttcccacctcagcctgccaagtagctaggactacagctgtgtgccaccacacccagctaatgttcaaaaatttttgtggagatgtgaattctttatgctgcccaggctagtcttgaactcctgacttcaagtaatcctcccacctcggcttgccaaagtgctgggattacaggtgtcagctactgctcctgactgagagtttagttttgtttgctagtggtgttcttggtatcttttcatatttgaggttttgggctagtgctgaagtattacactcaccattcgaggtctacaggacttttggtttaatattgaacagatggaactgtttagttctgcatctttgcaggtatacagaatgtgcctaccaggaatctgctttatatccattgaaagcaagaaataatacagtaaaactttgcctggcgagaggctttgaaagaatggcgtattctggtttaattctattactttggaagtataaaggtgaaaaaaattcaaaacttaaatttcctgttgaatgcaatttgaaaatatagccaatgattccacttttcttctctagtaaggttggacattctgatctacttggtgttttattatagaactgctagtgtgcgtgagtcttacattgtgaagatacttttttaaaacttgagatgtaagaggatgtaaacggttttgtaggagatcaggctggatgagaatggacacttgtaaacatactttttagactaaatctctgattgccgcttgtttttcttatggaactcatacaaataaaacacattggatggagggtgcgagtaggaaggagattctggtcttttaattgcatgtcattgtttcataacaaggcagaacatatggtaaccctggctttggacctacagaaggaaacacatttttctacctgctgtatgccagaggttcttgaacacttggagggattactgcagcacagattgctgaaccctactccagagtttctgattcaccaggtccagggtggggcctgagaatttgcacttataaaaaggtctcaggtgctgctggtgctgctagtccatagactacattttgagaaccactcttgtctattaagtgtaaattgtagaactctagaaaaaagcttagttcagtctgggataagaagcacacaggttatggagaaaatcatgaaagattcaacccttgatcccagcctagtgtggatttcaggtaacaagcagtacacagtgacataacacaattcttggttttcatgattgcaagtcatagccaggtatcaagtgagaaattcagtttcatttgcaaggcctagagaggcctggtgattctagaaaaatgggccttgtatttgttttaaaccagtaaagagctttaagtgcttattaaattgtaagttttgtgttcctacttattttgtatcttattttgttttattttatttcttttgagatggagtcttgctctgtcacccaggctggagtgcagtggcatgagcttggctcactgcaacctccatctcctgggttcaagtgattctcctgcctcagcctcccaaatagctgggattacaagcacccaccaccacacctggttggtttttgtatttttagtagagacagggtttcttcatgttggccaggctggtctcgaactcctgacctcaggtcatccacccacctcggcctcccaaagtgatggcattacaggggtgagccaccgcacctggcccaaaagctttgtgtttttaaagatattagacatgtttcttgtttttaaaagaaatcttaacaataatgtaggagaataagacaaacatttttccaaaaaagagaaattgttgtgattattctctgttattggaatgtcggatactatagtcagcttcattaatcatcaagaatgctatggattttccatttttatagggtctatatctcagttaaggtaatacttgtaattcttgtgctccatttgaagatgaaaaatataggccaaaatcatagactttgcatagaagctgcataatgaagacagctctggaggaacacatagatacacacagacacacatatataaagtatatacacatatattttttaaagtttatttttaacagttttaaagcttttaaagcaaaagccagcccctcccctctcccagagtgggcggcctctcccctctctctgagtgggcggggacagcggttgcatgggcagctttccttatgatgctacaggtccctctggacatgctgcgcctggccacgcctcctttccctttcatctttctcactgaccaatgggcttggaacattaaggccacgcccctattctgcgttccattggtgccctggttacgccacctgtggctcagttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaaggtaaaacacaccaggtcatggcccccaacccagccacagatcccctccgatgacaagaccggtgccagagtccataccactcctgaggcataccagatggggccccccaaccccagcccctctgggctcccccaaccaaagcctagtcagtcagccccaccccttcagcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagcgcccctaggaactgtcattactgctgcaagaccagcctttgatcttacaacccagtcccctaagttttctcaccccatttctggttcctctggttgcagcacaaatttccagctggaaggggagtggagactatgggacctaggagcaacaggtttcaggctgccttactcccttaacatagacattgacagtgggaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgcgggacatctttctgaagcatcattttcccttgattctcttgagaaaatgcattaatgtacttggggatgacagacacataggtttccaagcgtataccagactttgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcgtggagtcagaggactgagtttaagttccagtattgccttttttgatctttctttttttttttttctatccatgatatgaatccctctcagtcactgattgtgacaacaccttgtacagttgttggtggcattacatcagatggtatataagggtattttgtcaaaactgtaaaggaggatgtggctgtaggggctgatcattctcatgagtgttactgctcttctttcccacagttaaaagcatattggcagaggaagagccctggcattccagcaggagctaacaggaaaaagaaagtcaatggcagtagccctgacacagccacttctggtggttaccactcacctggggatgtgagtctcggcgggccaggctcctggggacagggggcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaagggtccaagataggcagaaaagaagcttttgccagttgatgggggaagaaaggaagtcagagggcttagacagtgaggggggacagaacatctccatgtgcactctcatctcttggagtcagcaacaggtatctacggggagggccgtgcatcctctactaccctgcaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatctttctccaactccttctctctgcatgcacctcagagccagtaccaagaactagcagtagccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgttaggggtccatattcctgccctgcctcagtccctaatttgctttttgagtctggacaagccatctctcctctttatgctcgtgtttctggaggaggtagagagtatcaaaggtctcggttagctctgaaagtcagagatttaaaggcccctagaatggaaagctcagggcgaagggctcctgtctgtcctttgctgttttatatctctgctatgaagaactgtacctggcctgtacatgctcagtaaatgtttgttgaatgaatgcacgtttctaaatcacaaactggcagaaggggggtgggcctttctcaaactctgtctctggaggttcaccagcccctccctccaggacccttttccccctttgctttgggcaggttcgcacatctaaggaggagaagaagcatgagatacatctggtacagaagcttgggaggagcttgttcaaactcaaaaaccagacgggtaagatggggctggcatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcacccacccacagtgctctctatctgaaagtgacttggaagattgtctaccatccgggtgtgaggagtcattagcagtgaggccaagtttgggaagcctgagaggaggagctgtgcaccaaagggaggatttttttttttttttttgagaatccagaggcccttattctctgcttgctttctcagctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctggtacgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcagacactaagttctggggtctccagttttagtgggtggccactgattgcttctctctgtccagaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcgggtgtggtggctcacgcctgcaatcccagcactttgggaggctgaggcaggacaatcacttgaggtcaggagtttgagaccaacatggccaacatggtgaaagctcatctctactaaaattaaaaataataataataattagccaggcctggtggtgcatgcctgtaatcccagctactcaggaggctgagacacgagaatcacttgagcccgggagatgaaggttgcagtgagctgagattgcaccactgcactgcagcctgggacacagagtgacactctctcaaaacaaaacaaaacagaaaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttacatgctgggaaaaaggacgtgagatttgatgctagggaaggaggcatggggttctaagcaagggagacagtctcttaggcctggagcaaggggccaggggcctgggcaggccacagagccccacagtgccctcgctaccctattaatgggccaggaatctggaagccagccaccacatgtcctcatgcccagggtcttccggcaggtggagctgaagagccaagaggctccgagtctgcagcagcagccagaccagtacctggagccccagtcccacaaggagcttggatgtgcggacaagcagggtggtgagtagagccctcaggcggggtgggcaggcaggagcaggggaggctcgcactgtgcccagattcccaccccctccctctctctgaagatcttagtgagctgagcctcactgatagcttggaggctgcaccgggagaggacagggagggttctcccccatgacaaccccactgcacagcagatccagcagctgcttcctctaatgcaggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtactgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaacttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcacccctttaccattagggtagcaagacaagacccttgtctaatggagggagacaaacagaccctttaccaccttgaccaaggctgagtccttacatttctggatgatgatgtttgttatttaagagccagaggttggtggagttggtttgtttggaggaggtctgatggccttcttactctcaccaaagcaacttttccctcaggggggctcccatcttcttactcagagaggcagctgaggcgggacagtggagttaactgtagaccaggccagggcacaggctgctgggggtggccccccttcccccgtgtacatactgtagctgtgtaacattctgtatcgtacctagcggaggttgcagctggcatatgaggaagaggttcttataattattcgcggctgggaaacttatttattgctagcataggagcgaggaaggaggcggggatggggtcatggctgcctggtgatgggactcctgttttttgttttttgttttttgcttttgattttggaataaatggatttagccatactgctcggcctgttatgttcccatttccctcactgggtcctgcagtttgtcccactgaatgaggagccccagagtgtctcagcatgtccagctgggctgttggggaccttccaggcctgttacctgtatgctgcctggtgacacctggtggattttatggggactgccatggcgcctacagagtacactctggccctgacagccaactggttgagaagcctgatctagctgtggcagggaagacagataccagtgcccaagggcactgacttccatccaccccacgtgtcttccattccgtccccctgcctccctctcctgtctgcaccgggtggcctgtctgtccctccagagtgccggctgccccgcaggttccctccaggctgagttcagggccctgcccctagtggccagagctggcttcacagggtaagagccagctaagctccagggactttccaggaaaagtgtcccttgaaaagggtgtgaccttttcactgctcccaacaacaccctaaaaatggcttggccttttccatcccctgagctccatagagaacacagccagcagaggacacattctctgtcatccagaaatgggtttctcagtcaagggacagcaggactggtagagactgtcaggccacacagctgcctgcacagcaccgccatgcttggccagaagggcgggagggatggcgggggctggctgtccacaggccgcgcatgtcccggaagctcactggaggtggtgcactttggaggggcgatgtcaggagacagcttcctcttgctggtctacaagactccacaagcacagcacggggactgattcccagtgctagaggtgaggcagttggccacgtgtatatatgtatatgtgtgtgtgtgtgtgtgtgtgtgagagagagaatttatagctatttatagaacagggcaggggcataccacagagggggcacaagtttcagcaatggtcacacctggacgtgtcagctcaccgctacaacagactaagtcacagaagaagggggctggctttggagctgggggagccactgtcaagtcacaggacacccgcccaggcaggcttggaaagggaggtctctgagaagagggatctgtttagaggtcgaagtggggcctggggctctcaggatgggatggacttgcctgacccgatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggagggagatggagggagaagccagagcttcataggtagtgcctggggactgcggcggccctccctaccccacacacgctggcctgtctcatggaacccaggcaatccacccatccacccacagttcagaccaatgccagctccctcgggcttccctcttctgtggtccccatgtcttccaacccactggcccagggccacctcttgcttggagagccccatccaacagccaccagacctgatagagaaggaacactgattgaaccaaaatggtggagctataagggatggctggctggagtgaatgccagaggcccctctgggccatcagaaagcccagggtcctctgagggaccctggggaaggcagggagggcaggtagccggatgccattggccatagacttctaattctaacaggggagcctcaactggttggcggggggctgcaggttacataggtgaggctgggcccttcctgctgggaaaagcagaagagggagactccgcggcaggaaagggaagtgagctctctaggtggagctcagctgggccagcagcactattggctgaatagcacaggcgacccctagaagcaacaggccaaggtgcgtgagcctgctggccagcagtagtgcttcagcaggggccagggaccctgccttcagtcgcacgctagcagctatcatggtacctgggagggagggaagggggctgtgtgtccttccatggcctatgaagtgtgttgtgggatgaccacgtgtataggactctcaggcttttatcctagatcaccactggattgctgacagatagaggacgtgggaccgtgactatcacccctaatctgcagtggatttggctcttggcactcccaggctgggagctggatacctgccctggcagcatgactcagactgcatgacaggtacggcgtgtccaggatgatgtgcccaggcctctggccgcctgagtccagccccccacacaaccccctccaagctcccagcccctacaccataaaccatgagctctgtgccctctctgatggttccacatctgccaccttgggcatggagcctgttgtaagagcccccaggctcagccatggagaccttgagcagtggcactgagtcccgtggctcacagggagcaaagtgagacaaccagcagcacaaggacagaaagaggaaagagcaagtctgcagctccagaagggaggggcagggagcctggctctgagactccaggcatgccccctgtgtggagctggggcagcggggcgggcagaccattcatgcagcaggcagtgagacttgtacctaccatggctgacgctcctcaggggccactgatagtgattctgaaagacagcatcaaatcacatggcaggtcccatgcatgggtggggcaggcctgggggtggcagacacacgcacatgccagattgtgcacacacatgctgtgaggccccacggcccgcatgcacactctaacagatgcccacaaacaacacgcatacgtcgccctctccgccacctcccggtgcccagcaccctcaccggccggcacgtgccgcatggatctggggcgtgcagccacacggcacactgaagcacatgcgtgggcagagtcacaacacagatgctcacccgcacacagaggcatttgcaccagctccctgcacactcgtgcctggcgtgctcagaggaccacccatgctgctcagggagacagggcttgctcactaatgtccggctgtcatttctccacctaagagccttccatggctccctactgcctacagcgttgaatcccaacaagtcatactttttggactttgaaggttctccaccctgtgccccaccctccccacagagctcttcctcattctgtctctgttccctgctttggccagtggctatccgcgatgtgacccacactacacctctgcccacactgcagctctttacccagttaccctccagttcctcaccacgtatgcctacctcagtcatgccccggactgcattgaagccaggctgccttgaagaagctctcccagactgcccttttccccaaggcagggtcatgatttgccaaaggtttcgtgtgtgttagcaagactggagtcggagcaggcgtcaaactttacatcccatatgtcacacctcaccatagatctgggtgccaaatagcctgaagagtctgaactcacgttggaagttagcaaagtgctcctacagccgcatctgcagttaacatagtatccctatggccactgtctcccttgatccccacagccatcctaggagaaaggcagaacgtcatttgctagaagggatgctgaggctctgggagggaaagggacttgcctaaagccccagggtgaagcagcatctctggactctcatagacagcctagagctgccagcactcccttaggatctgtgccctcaggcctggcttaattttttcctctgcaaagagccatctgtagggccagaggctggcaaagcctgactcattactggacgccagttcctttgcctgacattcagtgatttctgccttaccctggggttttatgttgcttgtctcaacactgtcacttctcattcctccacaagttgaattgctcactccagccacttgaagcatgctcttcttaacacagttagctctaggcacatggttggtgctaaaaaggaaaaaaaaagaagaacgttatgtcaatttcattgattaacaaaagcgatggctccactgcaaagcaaagttgacactcctgggtctctgagttcaagagcctttagaaaaatggctctgagctaaaacatgatcatgcacgcatatgcatctgtctcggtctgatgagataatctggatacttgcttgttatccttgagcattttcctgcctcattaatgtatgtgtagccaccacaataataatcatagctaataatggctacagctgagggctttcctgaaccaggcagtggttttaaaaactttaacccctaaagctgaggactttcctaagctagatagtggctttgaaaactttaaagttttcacatagactgtcactgaataatttctgtttttcagatcaagaaactgagacttactatcatatttgggattaagctaaaaaaaaaaaaaaagaaacagaggctgaacgcgtcaagtatttcacagccagcaggaaatcagaacttgaacccaggcagtctagccctgggatcctttccccttacccattatccagtgttggctacacaaaactaatgagtacatattttcaactatagtttaagtgggtgacatatttttcactatattttatgtaggtgactttcagtttgggggtattctacttacacaatctattgagctggatattaactgagagcaaacagaaactaatgaactctgaaaaacataaaacatgagcaacatgacatcactgcaagagacaaaacagcacatagccttcttgtgactgtattttgctgacagtccatgagatgatagcctgaactcagcagtgctgttcccttgggagacacacacacacacacacacacacacacacacacacacacacacacacacgagttggtggttgtgctgcccggagcctccagtccgcgagtgtgaagaacggaccagatgggtccagcagtgctgggtcaaggcgaggagggggcagccggaagcgcgcgcatgctctggactcctgcagccgccaaaacgggtgcgcagggtgcacgcgggttgaggggtgaggggcgacgggtgtgaggggcgagagggacgggagcggggtaggggcagccctttcccaggcggtagcgggggctgtggtgctgttgcccttttaagctgcggcttgacaggagcagcgtctcctgtcggtggagtctgttacaaggggagcagccgcccaggccgccacacagctccccgcagaggcctcggtgccccttgccattttccagccctactccgactagagttgaggcagcagggagaggcggagctgggagagcgccgccgagaggtcccgcgggtggttgcggccgtgacagcggctcccgacgggctcaccttccgcgcccctcccgccagaggtgagagtaaaatgtccgtgtgagggttcaaggccaagctgaggttgttggcctctatcttccacaagaaccaggagcccccgccacagctcacgctccactgcaacatcacggtgaggcgcccagtggcggcctcacgggccagggcgagggcggagaggaggcgcccagagtcccgggacaaaggggagcctgcccgggagaggccccggttccccaggcggggcgagcgcgcccctttctcccgcgtctggcccgccccgctgtgtgaggcttgcgtgggaggagggggagggcgcgtctctctggctccttgccgcggggctggcttgggggctgccggcacctctcgccccagtcgctgcgccctgaggtgggagcccgcgtcgcccgcagacctgttggggcccatgatcgccctcagtcagctagcctgctcccctggaccgcgacggggcgtggcagggcggctcccgctgttgtttgagcccagtgagggaaggggaaaggcctttaagattttcggttttttggccgggcgcagtgctcattcctgtaatcccagcactatgggagactgaggcagctggatctcctgaggtcaggagttctagaccagcctggccaacatggtaaaaccctgtctctactaaaaatacaaaaattagccgggcatggtggcaggcgcttcttgagatggagtctcactctgtcgcccaggctggagtgcagtggagcgatctcggcatactgcagcctccatctcttgacagtctgtgggttcaagcgattctcctgcctcagcctcccgagtagctgggattacgggcgcccgccaccacgcctggctaagttttgtgttgtttagtagagatggggtttcatcatgttggccaggctggtctcgaactcctgacctcaaatgacccatctctgcctcccagagttctgggattacaggcctgagccaccgcgcccagatccaaggcccttaagcttaaatgcctcgttcttcagtcaggttttccttgttcccgcatgttcagccaatcgtgtttaaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggtaagagtcctgtccaggtgctctgcccgcttttcctttcaggcttctgtatcagctgtttttcccctgtagaatgtgcccctgacagccaccccctaaccctacccaatttgtctttacgtgtctgaccatcaaggctcttctgggtcatatttaattcatgctgatatttccccttcctcccctctttagtcctatttttgctttggttatgttatgctatattctgtaaggctttaaaaaaatttttatggtggcaggggagaatgttttataattatgctttgtgctttttatcttccactcaataaatgcttggtaaatatttgttttattgaatgtatgaccctattctagctatattgtgcttgaacaaaaaccttaactgcctagtaagttaactgctaagaatttgtcagaagtgcagacataacatcaagaacttgtcatggatagtacaaaaacgtcacttaagggcttggtggaagcctgtaaattgacttcctatgaaagagagtgtaagaagtgaaaatgtaaagcatgactggagagccagagtgatgaagccagggtccctttctccagatcctttgtaacagtgttatgtgatctcttctagaagatcgttctgaaagataatgccaactcggaacctaggaaaccatccagtgggtttctgcagcttaggtgtttcaaatcctcatcagcacgtttgttttctctgcctcagtttgcttacaatgatgttctcagtagctacaattgctgtctttgaatacgtaagcatttttttttaggtgacagggatatatgtgcatttttattttaccaagtgttagaattttgactctgcttttgtgggctctgggttagctacttggttgttgtaaaatgattagcagggaaagctgtgtgtgtgtgtgtgtatgtgtgtgtgttataagtttcttttgttgtcagaggacttagaattttattttatatggtaattctgtcaatttactttattctccaccccacatttattgaacagcaaattatgaaagtaatgtgtcccataagcagccttcagaagaattacaactgctgtatatctgaaattcttttttttattttttattttgagatggagtctcactctatcacccaagctggagtacagtggtgcaatcttggctcactggaacctctgctgcccaggttcaagcaattctcctgcctcagcctcctgagtggctgggattacaggcacctgccaccacacctggctaatttttgtagctttagtagagacaggtttcaccatgttggccaggctggtcttgaattcctgacctcgtgatctgcctgcctcagcctcccaaagtgctgggattacaggtgtgagctaccgcacctggctgaactttcaaggagaagtttgtgcatcagttttcaaaaaattatgatatcaaaagatagctgtgccctacatttggaaagatacaaaaactgaacatactggcaggcagttttgcttgctggtgcttgagatagaggcacacattggtctcagtggaattatggagaaaaatagataaagttatttctaaataagaccaaaaaatccttttcttaagcagtgacaggtaaagaggttgtcttggctaaccttgaattgtgttgcccttgattgagacagttttatggtgggatggtagtggtgataaacttgctggaaatttgtctgcttatagtaacctttgtggtagctgtcacagacaacttcatcctcacaggccttgaaattagtataaaactaacagaatggaggagaaacaaaggacctgaataattagatgcttagataattgttctgtgttttcattactggtgaaaaagagcagtattagaagcacttacacattctatagaaggaacactgcctgaatttatattgcgatttttgagcaccattaactgtataaaaacaggcatattgtaggtaatattttaaagacaaacagaaaatttatcttttcaagatggatctaaaacttatcaaaattacaaaatttaaaacgtgattgaaaaatattaatgtataggtttaaatattggtcattttaaatgtctttcaaaatagattgtctcttaaatattcaactgaacaaactttgaacatgttgtagagtttgtgccgaaggttaaatttcctggggtgatggatattttgtaatatggaaaacaaaaccttcttattttaagaaatttagaaaacttttaggcaaaactagaaaatattacctatgtaattctaccactcagaaggtgccactgtcagaaatttgtatctttccagtcatctgctcacctcttttctcctgtgcttgtgtatgtttcctctcccttaaaaatcagatatttgtttgtaatctgctttttcactcaacagtattgtagatccatgttataacttactcctctacattgccttcagttattgtgtgctttctgttggatgactttaccatgtagtcagtcatgttttctggtactgaatacatacgggtatgtgtgtgtgtgcgtgcgcgtgtgtgtgcgtatttttttgtaacttaactaatgctttagacatcagtaggtagacgtaaatccttgaaaccttccacgtggtgactttcagttctcattgctgaatttgtttccagagatggaagaaattatattgtatgggaactttttttttcttttttttttctttttttttttgagatgaagtcttgttcttgtcacccaggctggagtgcaatggcgtgatctcactgcaacctccacctcctgggttcaagcaattctcctgcctcagcctcccgagtagctgagattacaggcgcatgccaccatgcctggctaatttttgtatttttagtagaaacggagtttcaccatgttggccaggctggtcttgaactcctgacctcaggtgatttgcccacttcagcctcccaaagtgttgggaatacaggtgtgagccgctgtgcccagcctttttttcatctcagtaccagcttttatttatcagattggtaaaaatgttagaaagtgtgcaatgaaatgggcattcttacagtcatggcaaaaaatataattatctttgactttctagaaagtagtttggctttctagaaacttgtttgaattctccctgtttaggcaggatgaattctcactaccccaaggtggccaaccttgtccctgtgattccatctctcccagaaagagaggtctagtctcagggaaaacccagatttgtttggcttagcccatctgacagctaatcactggaaatggggtaggctggtagaatgctttggtcaggttttgtgttgagagagaggtggaaagatgggagggaggtagcaaaacttgcctcagtggaactatgtaagttaatatagaatggcaaagggatgtttcttccaaggaagaaattctagagaaggaagaaagtggaggggaaggcagcagttctccaagttttggggtcaggattcctttacactcttaaaaatacattgaggtcccaaggagctttggtttatgtagggtatatctattggtatttatcactagaaattaaatcagaaatatttaaaatattgtttaaaagctcaccacatattgttataaatgcttttatgaaaagaaaatttctaaacccaaagtagtacagtcttacatcttttgcaaattattttgatgtttgatatgtcatttgcatgatgtttgatatgtcattagcaaattgatatgtcagtttgcttctgcattcaatttattgtgtgatattttcttgaaaaaatgtgaacaaaggccagtctcatacagataaccattttagatcattgtggatatatatatatttttttgagatgaggtcttgccctgttgcccaggctggaaggtagtggtatgatcatagctcactgcagcctcagtctccagggactcaggtgatcctcccacctcagcctccagagtagctgggactacaggtgtgtaccaccatacttggctaactttttgtattttttgtagagacagggttttgccatgttgcctaggcttcttttttgatactccatcaaatcttggtttttcttgaactttggatcttccacccttgcatgatattacaacatcgtgcattggtcacttataaaacagtggttcactaagatcttctacatgttgatacatttgtacagtatcaaaatacattcatcagtaccaccatcaatctcatcagaatacttttggaaagcgatggtgggcataagttttctaaaattctaattttttgttcaaaagcttgaattttattagtaattttgttattgaattttattatagcctgtctgttgttttccttgaaatgacagaatctcatgttttgagaaaatatctgccagaaatgcgagttaaaataacattttttgtcagtcagcctttcaagtaaaaatggtattccattaaagtggttaattcacttcatgacttagccactcaagggtttttcctcaggcagcctgtaggaatgctcatgtatacttcccatttcatcacttgaaatattaaaaagatatattcaatgatttagatatagtaaaatattcactgcttcatcatagacattcttttttttttttttaattttcgagacagggccttgttctgtcacccaggctggagtgcagtagcgtgatcacagctcactgcagcctcaactttctgggttcagtcaatcctcctgcctcagccttccaagacgctgggactacaggcatgcagccactgtgttcagctaatttttgtattttttgtaaagatgaggtttcaccaggttgcccaggcaggtcttgaactcccgggctcaagggatccccctgcctgggccttccaaagtgctggaattacagacatgagccaaaattcccaaacttatcatagacattcttaaatgaaactgaccttttgttgcccttcctttttatttttatttttggagacggagttttgctctgttgcccagtctggagttacataggtgcaatttcagctcaaggcaacctctgcctcccaggttcaagtgattctcctgcctcagcctcctaagtatttggtaatacaggcatgcaccaccacaccgagctaatttttgtatttttagtagagatggggtttcaccatgttggccaagctcgtctcaaactcctgaccttaagtgatccgtctacctcagcctcccaaagcactgggattactggtgtaggccaccatgtcccacccacccttcctttttaaacctttcctgtgcctaatgaagaataccatgactactagtagtttggtgttactgcttttgtttgtgctaaagtaccagcatttttacccaccattgtatttgcacacttacagcaaatgtcaccatgttagtattcctgtcaaaatagtttggacttgggggtctgagggccgcactttgggaaccattgaaataggtacttagacgtactagatatcatatcttttcatctacaaggtttttaaaaacttgatttcagttaattttttttttgtaacttttaaaatatggttttgaggggtttcagtccagagcaacaacacgtattttattttgcttatgctgaagtttactagaaaatactaacctaacagaatgaagtcctaaatctaattgcaatttccttagccaaaagaaaaaaaaacgaaaattaaaagtgtaaaaatagtccatatggtgtattctcagtgtatgctgaagaatttatagaagaaaatgcaatactcagtaactggtgttctttaagaatagggttggctgggcgcggtggctcatgcctgtaatcccaacactttgggaggccgaggtgggtggatcatctgagattaggggttcgagaccagcctgaccaacatagagaaaccccgtctctactaaaaatacaaaattagtggggcatgatggcacatgcctgtaatcccagctactcaggaaggctgaggcaggagaattgcttgaacctgggaggtggaggttgtgatgagctgagatcgtgccactgcgctccagcctgggcaacaagagcgaaactcggtctcaaaaaaaaaacaaaaaagaaaaaaaagaataggagtaattctgaagagtttcttttagcctgtaaagagatttggaacacagtaagagaggaatgagaagaatgagaatagtaaaataaaccattattgaagagatatgctgttaatgatgtcctccatcaatacaacttgtttctctttttgtttgtttgttttttgagatggagtcttgctctatcgccagcctggagtgcagtggacatctcagcccactgaaacctctgcctcccgggttcaagtgattcccctgcctcagcctcctgagtagctgggactacaggcacccgccagcgcgcccagctaatttttttgtatttttttagtagagatggggtttctccgtgttagccaggacggtctcgatctcctgacctcgtgatccgcccacctcggcctcccaaagtgctgagattagaggcgcgagccaccgtgcccggcccatcttgcttttcttaaaaaggaaccttcagtaaatatttggtttctgtggcttcagctttaactcagattacagttttcaaagcactgttgcctaaagttgtttgtgcaaaattgttttctgtgacttgaacctagttattctgaaactaatatataataataatggtttttccccaatttataatagagaacagtacaaagtaacagcgggaacgtctgttagtgggtgaaagcacataatgcatagttcattagcttttttaaaaaatcacatgtaattgtgttacaaaaatatatgtatagtaatggcatttacttggtattacctggtttgtgtgatagaataaaatattagaattttatggtgtttgagttagttatctattgctctgtaacaaactgagcagcttaaaataacaaacattatctcagtttctgtgggtcaggattctgtccagtttaccttgggttcactggcttggcctctcaccaggcagtgaaggtgttggtggtggctgtgatcatcccaaggcaggatagggagagaatctgtctccaagctcaggttggcaggattcatctcagaggctgctggactgggcctccgtttctagatggctattggtcagaggctttttacaataccttgtcacgtgggcctctccatagggcacctcatcacatggcaactggcttccatcagagggagcaatggaaagagcaggagaagggtgaccaaggcaggcatcgtagtctccttgtagcctcacctcagaagcgatgttacttttgctgtattctctttgttagaagtgagtcactaggtccaggggtggaattttacaagggtgtgaatggcaggaggtgagggtgatcagggccatttagaggctgcctaccagtgttgaagaaaattgttgacttctatgagctgtagcagcagacagtgctatgcaaggagaatggctgtctcagaagtccagctcctcacatgggtttaaacgtgttgccttttccccctgatacattttgtttaaatccatggtcatcttgccatttagtggtgtggtttaattgcatatttgggttagtctgtatgtaaacatttaacataggtgtctctgggttaaacaggaatcctattcatcttcttcaccgatatggtctgtggactctgatgagccaaatctgacatcagttctggaacatctagaagatactaaggagaacagttcagtaaggaaagaaaccaagctattttctcttttcctcatgaacattatatttagaaattaaatgttaagtgataatattatataaaaacatgattaataactataatcttagaggaattaaagtctgggtattttaagtcctccaaatcttatttactacctggtttctctttattatttcccacatgtataatcttagtttagattagcaattcgggatctctttttccctgaattctaaccattaagccaagcaagcattttgggtggagaccactagccaaggtgggaagtagaaagaagaccaaggtggaagtgaagggagagatggggagaatgacaccagaactagtgggagggaattgccttttctttcaagggtctgtaagtctgcagtaaaagtcaaaggtattcaaataggaagttttgtttttgtctttagtatataaagaagcataactttccattttgcaaaaactttagaaatcttttttcttgattataaaacttataagcaaccattattgagaagattagtaaaatataaaaaaataaaaatctcacataatttctctacctaatataagtactgttgacatgatagctagtttctatcagtatgtattgcttctttgttatcaaagtacttatacccttacagatatgtttaaatagttgaggtcatattctataaatatctataaatagctgggtgctgtggctcacacctgtaatcccagcactttgggaggccgaggcaggcagatcacaaggtcaggagtttgagaccagcctggccaatatggtgaaacctcatctctactaaaaatacaaaaattagcccggtgtggtggcaggtgactgtagtcccagctactcggcaggctgaggcaggagaattgcttgaacccaggaggcagaggtttcagtgagtcgagatcgcaccactgaggtccagcctgggtggcagagcaagactccatctaaataaataaattatgtatacacacacatacacacaccctcatatatatatacacacatatgtgtgtgtatatacacacacacacacacacacacacacacacacctacacatgaccgattgcctcgcctctagcattgggaatcagtcaccgtgctgtccttgtggagtcttgtggcccaacaagaggaagctctcccctgacattgcccctccaaagtgcgccacttccagtgcgccccactgtcatgcccggcctgtggacagccagaccctgccatccctcccacccccgaccaagcatgggggtgctctgtaggtagctgtgtggcctgacagtctctaccagtcctgctgtccctcagctgagaatcaaacccatttctggatgacagggaatgtgtcttctgctggctgtgttctctgtggagctcaggggagggaaaaggccaagctatttctagggtgctgtcaggaccgatgaaaaggtcacaccctttccaagagacacttttcctggaaagcccctggagcttagctggctcttatcctgtgataagccagaggctctggggggtgagggagcagaaaccctcctcaccccagccaacggggacctgtatacctctgccagtctctcacttggccttgctgctgtcctctgagactgcctgttcctccctctctgtgactctacaccaccatcacctcctccaggaagtcctctggattgactcctagcttattacctctttattgtgcagaccctctccattcaaagcccctcttcaactgccccccccccccactacctccaagacagagattctgggttcttgcaactgcagcccctcagagagtgtaagaggggcagaaaaaggagatcaggaggtgagggaagcagcgctgtcagagtttccaaagccccggccagcaaggcctcagaggcctctgttggagtgggggcctccctggctatgcgctccagctgcacaaggcagcctctgtgagcctctcccactcagccctacaggaagcagcagggcccagcctcaatggacccattcagaccccagcgctccggaaagtacctctgcttcctgccaccattccactctggccaaacaggctctactctcttctgatgggaggaggccgcaggcaggtggttcagtggttagggccaaccatctacttcagttcctgtctggcccagatctctgaccttgaccatgccctagtgggtgtatgtatacctttagtgcaagggtggtgtgacagttaatactgagtgtcaacttgattgggttgaaggctgcaaagtattgacctactggaagtgtctgtgagggcattgtaaaaggagataaacatttgagtcagtgggctggggaaggcagacccacctttaatactggtgggtaccatctttctaatcagctgctagcgaatataaagcaggcagaaaaacatgaaaaggtaagattggcctagcttcccagcctacatctttctcccatgctggacacttcctgccctctaacatcggactccaggttcttcagttttgagactcggattggctctccttgctcctcaaacttgcagacagcctattgtgggaccttgtgattgtgtaagttaatacttcataaactcccctttatatatctatctatatctatatctattatctatatctatatctatatctattatctatatctatatctatatctatatctatatctatatctatatctatatctatatctatatctatatctatatctgtctatatctcctattagttctgtccctctagggaaccctgattaacacaggtgggtaggcacagggagatgtgcccccttccccgtgggtgctgggtaggtaaatgtttcgcaaagggctttgttggggagagggaaccctgattttcagtatttgcctcttttcctggtataaatattcccactgtgggcagtatcacctgcctctcaaaattcctgaaaattcaacagttggctcctggcagctgctgtgagccgttccagccggtgactgtggtggctccatcctgcagggccatgtgcccccaccccttgtgctatggcctccctcactttagtgtgctgtgttttgctcttaggaatcaatgtctttgcagataaggcaccccagtagctggccgccacctgcagttccctggtctgtctcttgctggcaccaagctgtgctgtgcctgctgagactgctgggccacccccgtgcagatggtctgcggggcttgcttgattcccttagcttcccagccaaggtgctggtgttgccagcagtgctggcaggaggaggggataactagaggggatttaactcaacccgaggggctcttacgggatctttcctggatatccctccaggtgggactggctgccctgagggtatacaaacctccaactcctccaatggctgaagctacttcctcgagcagatggcagctggctcaggctggctagggaccagtgcatgtgaggtcggtgctggatcaccccatcaaggccatcagcctgtgcttgttcttggggtttgagggaaacccaacagggatgaatcacagtttttaacctgtgtttgtctgccccccagccctggacatctgcaggcaaagttaaagttatatttggctcttatcaccgcaaaaggcatagaccagaaattatggcatcgggttggaagtcagggaggctaatttggggaaactgcctggaggaagcagcaactcaaaagaggaggagtcccagtgtgggacagaacaggccctgcataagaaccactaatcccaggcaagcccagacatggccttctgcctggggaggccctctttggcctgctcagcagaccctcagccccttctaggccctgtcttcagcctcagactgagtggtggcctggggaggttgggagctgagctgttctcatccctggttccttggccacggtggaaacaatggggccggatctgactgctcagcggggactgtgaatagctctctagcaggaagcaacagcaggggtagtggaggaagtgtgggcccactttggtttgacactgcatatggtccccatctggcctgagagcctttactccttggcaaactcaggccaataagctcctgcccccaccctcaatggcagctggaagaatggcctgagggagaagcagggataggtgggctgcactgacatcacccccagatcccagccgtggccccagccaacccatggaggtggggcatggcacggcaggtgctgcacaggagcccaagcacaagggcacttaggagaaggaatctgagcagggatcgatctggcctggtggtgattctccagaaactccattcctcagggctgtgaccaccaagccaggtgatcaggccagtgatgtttccctttgggccaggtcggggagccagacctgggagggagactcctctggggcccaggggaggtgagtcagagctggcagaggcctctggctccaggaacctccaaggaggagacctgagttgctgggaatttctgggtctgacctcctgccaagtcaaggtctgggctggacacaaggtgaggctgtgccttctggtgccaggaccaaggaaatgctgggatctgggcagtgctcagaggcagcaccgtatggcagaaccatgagggtgcaccagcacggacccctttctgcaacccacccatccctccctgcagcacctcgcctcctccaggcaagaatctgagccttgaccacagctccctctctcacacagcttccttctttggttagaaccacccggaggtgactgtggccatggctctgactgacatagacctgcagctgcagttctccatgtcccaacccgaagccctccttctcctggcagcaggcccagctgaccacctcctgctgcagctctactctggacacctgcaggtgagtgacgtccccctgggattggggcgagattccttgtctagctttgagtgaaccccagctggctgttgaccttgtgtaagtcacttttcttggggtctcaagttctccactgtgggatgggcagcagcagctcagaaatggtaaatccttcatgaactggctctgcccaccggctccttccaaccatgtttcccaccacaagccctcactggccctttgtgctctgactgcactgaactgctttcagttcctggccatcttatggtcacttgctgccaggcctttggtcatcacactcctcctgccaggtgtgtgacccacccattccctgtacctgccgaactctagtctctccttgaagtttcagtgtgggcatcccctcctcctcggcgagaccccctcctgggcccccatgacccctgcgcatcctggtggcactgcaccaatttatctgcagcaccactgtctgtccatgagagtaacagcaccagtactgcctcagcttcatttttccatttcatccttcaagacaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgttgagctctgcaggtagtgatgccacatccctacagagatgcaccataccaggactccaagatcatggttcttagtgttctgcctctgcagttcccatactctgccatcacctattctagcatctgggagcaccataccagagccatttcttgtgtcaatgtcatggtgacagaactatgtccttcatctctccttgagatattcctccaccacaggtcaggcagcttttttttttttttttttttcccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttctcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtggctccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgatgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcaccttccagctccttggcaccccctctggcctccccgtggagcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccgtgtcaccggaggcctgccgttcagggagctgcagaagcagggggctggtggggtggaggatgctgagtggtgggtcacacaggcgttccaccagcaggatgtggagcagggccacgtgaggtacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacatgcctcagtggcagtggaggacaccttctgtttccatgtcacagctccaccatatttctccccactctgtaccttctccatccatattggcggtgacccagacatgcctgtcctcgtggtgcccgagggtggtgggtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccatcaggaccagagcagtggtgacgtggcctgggaggaggtatggggtgtcttctgagtggccatccagcctgtgaatgaccacgcccctatgcagaccatcagctgcgtcttccacgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgtgtgtgtgcacgtgcctcagatgtgctcccatatatgttgtgttcccaagagtttctggggagcttgctgtacacccatcctcctgggagtggtgtgtgcctctagagctggtgtccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtaccccgctctcttctcagagcccagaccaggaccaggagggtctgtcaagggcttctgctcacccaggaaccccacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccacgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcgtcagcatctgatgaactcatatgtctgtgtcactgagtctggggacatgtgattatgcacctccctgagggagtgcatctcaagctgttgaccgacaccccgtaaccatgtgtggggtgggtattaacatgtgaccagctggggcaacccagtgaaaccccatctctacacaaaacatttaaaaattagccaggcatggtggcacatgactgtggtccccagctacttgggaggctgagcccttgagcctaggacgttgaggctgcagggagctgtgatcacaccacagcactccagcctgggtgacagagtgagaccctgtctcaaaaaaacaaaaaatgtgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctgcttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtactgctggggcctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccaccccccatgtctgctttgagaaagaggccaatgtcccctacttcccggcacagatctcccccactctgagcctcagtttcctcctctgcaaaatgaggacactactgtgtgcctcacgcagttgttggaaggagagatgtgagattgtgctgaaatagaacacaggtgggaggttttgttattggacatttgcaagtacggtaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtggaggcctcagcttggcttcccaaactcctgccccttgtccacagcagagcagggcccccatttggcaaaggtggaagttgaggcccagagatgggatggaacttctccatgattgcaaaagtagttctggtggaacagaaagggcatggctttactaagcccacgtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggacgccacagaagagtgggacacagcaccctggaaccacaggctgggatggctgtgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagagtggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagctagattaaggagcactgttggtcagcgctgggggtttctgggggtgagaacttggtgacggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgggtagtgcagtgggcggtgccgggcactgaggtgcgcagcttcaagcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacggaggcatccactttggcctctctgacggtgaacatacttcctccagacacttagcttctgagtgacggcccagaagcaagtgcttcactcgctggagggcagccggacactgactgcccaggtgggtgtgctgattgtgggcgttcctgggtgcggggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggagtcatcaggctggcagggcaagttcatgttcccagaaggagggagaagaatgcaggaagtcggggatacagggccccagagcagggctggggtcttggggtgtggcttcccgaaggaagctagagctggacccaagggtctggagagggagaaccatgtaggggcactagtggcaccccagcagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaactgtgccacgggggccagcccactcatggtttaaatgaacacctctccccaaaggcagaatgggagttgttccatagcagggcagggcagggcagggcagactcttgtgggccgccctgggcaggcagcacacctgatgctcccatcaggaggctgcgtgagcatctggacccagcacatgatcacagtgagttctcggcagggagcggtcttgtggggcgcagagctgactctgtcactcaggagccacggcacacagcactgccccaagtacctccagaggggatccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggctggtgtctacagctgctgcgtaccctcagttgctgggagcctttgtcaagaatgcccaggaatgaggagggcacaggacccagaccatcagcaaccctcttgcactctatagtcccatgttactcagagcttccccatgctccagcaagatgaaggactagattgaatgggcaccaggctggcagtgccacccaggaaagctgggaagaggctacatgggctacctggcccactcagggaggagggcaggactgggtattgtcttgacagcaaccctgtcccacaacactgaactgggcagggaaggggtcaggtgtcctcatttttcagataagaaaactgaagctcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataagtcttaagtcccctcccagatctgtgacatttgacaggtgtcttttcctctggacctcggtgtccccatctgagtgagaaaaggcagtggggaggtggatcttccagtcgaagcggtatagaagcccgtgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcatgacgagatgctgcacatgcaccacgcgctgaaggaggcgctcagcatcatcggtgacatcaacaggaccactgtcaccatgcccatgcccccgcccgtggacgacacctggttgtcagagcatccctgacgaacacaggtaccaaagactgccccccacggccccaaaatcccccacccgggatgcccagaggagtgccctgggggcaagtggcacaccccctcaccggggtggctcccacctggagtgacggggggagcttgacaaggagcactggctgccggggggggggggggtgtgtggagctgggatgttctcgctgctgggggcggggcttaagctctggcaaccgccttggggtgtggccggcactgcgctggggcggggtcgcccatctctcccctccctgtgcctcccaggtcgcccaagtccagcgtcaggatgcccaggccctgccatgtccctagcccggcctgggtggcagggcccagctcctgggcggcaggacccagctcctgggcttcctcctgccgggtccgcccttggggaagcgtgccccataccctccaggccagaggcttcccctgatccctttgggccctacccccctggtgctctcgtgccccagccggggtccccaggtaagtaggggctgaatgcggctgaagaggccgctggacaggcgtggccaggaaggaaatgggactggattccagagcaccacatctggccgccagaactggccgtctccatccaaggcactgggaccatgggtgccggagccacgtgtggccgagggctggcagagcctgccccccagggatcactgagtcctggaggtggtcgtttttgaggagggggctgtggggctcgtcccacctgccgccttctgtccagcacttgcatgacacttccctctattttcactcttggcggctgcccacacgttgcatttctcttcctttcttctcgctgtcctccatcctccattccgtccaactcctagcccagtcccgggggcgcctacttcaggtctgagagtctgaactccgagatgctctgggtgtgtggatttccttcagctaccctgatgtccccacttccaagtcctgactcctttgagccatcccagggggtgtccggccactggaccacaggagcagaggcgagtctgtgactgtgtgaccagcaaggtgtgtgatgtgtgcgtgagcgagcacacgagtgtaaagaatggcacccagacctgagctaggacagagggagcctgggggccacaggcaagctcatttcttctccacacccctccccgcccgaccctgtctaaactaatggggtagtggtagccgcgagggcagggatgggagtggctgaagcctacttcactcccaaagatttctaaggaaaatggttctactgcatcctttggctgggccttgttgacccgtgaccctctttcaagaacattcactctgatttccagtgtgccgtctccactggccacgttctctaaggaagaacaatagcatctgtttttgtttccaaatggctggagagtggggctgtgggaccagcgcccatatataaaaatgaagcagggattggggcttgccctgtgatgtgctgttgaccaagttagaggggtataggcaagcagcaaagtattgggcaagatcactggactgggagtccagagatgctgcttcaccctggggctttaggcaagtccctttccctcccagagcctcagcatcccttttagcaaattatgacattctgcctttctcctaggatggctgtggggatcaagggagacagtggccatagggatgctatgttaaccgcagatgcggctgtaggagcactttgctaactgccaacgtgagttcagactcttcaggctatttggcacccaggtctatggtgaggtgtgacatatgggatgtaaagtttgatgcctgctctgactccagtcttgctaacacacacacgaaacctttggcaaatcatgaccctgccttggggaaaagggcagtctgggagagcttcttcaaggcagcctggcttcaatgcagtccggggcatgactgagataggcatacgttgtgaggaactggagggtaactgggtaaagagctgcagtgtgggcagaggtgtagtgtgggtcacattgaggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctcttaggtggagaaatgacagccggacattagtgagcaagccctgtctccctgagcaggatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgcggcacgtgccggctggtgagggtgttgggcaccgggaggtggcggagagggcgacgtatgcgtgttgtttgtgggcatgtgttagagtgtgcatgcgggccgtggggcctcacagcatgtgtgtgcacaatctggcgtgtgcgtgtgtccgccacccccaggcctgccccacccatgcatgggacctgccatgtgatttgatgctgtctttcagaatcactatcagtggcccctgaggagcatcagccatggtaggtacatgcctcactgcctgctgcatgaatggtctgcccgccccgctgccccagctccacacagggggcatacctggagcctcagagccaggctgcctgcccctcccttctagagctgcagccttgctctttcctctttctgtccttgtgctgctggctgtctcacttccctccctgccagccacaggactcagtgccactgctcaaggtctccatggctgagcctgggggctcttacaacaggctccatgccgaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccgagagccaaatccactgcagattaggggtgatagtcacggtcccacgtcctctatctgtcagcaatccagtggtgatctaggataaaagcctgagagtcctatacacgcggtcatcccacaacacacttcataggccatgcaaggacacacagcccccttccctccctcccaggtaccatcacagctgctagcatgtgactgaaggctgggtccctggccagcactactgaagcactactgccagccagcaggctcacggaccttggcctgttgctcctaggggtcacctgtgctattcagccaaggagaccacagtgcttgctggcccagctgagctccgcctagcgagcccacctgcctttcctgccgcggagtctccctcttctgcttttcccagcaggaagggcccagcctcacctatgcaacctgcagccccccgccaaccagttgaggttcccctcttagacttataagtctatgggcagtggcatctagctacctgccctccctgccttccccagggtcccttcagtggaccctgggctttctgactgcccagagaggggcctctggcgctcactccagccagccatcccttacagcttcaccattttggttcaagcagtgttccttctgtcaggcttggtggctgttgggtggggctccccaagcaagaggtggccctgggccagtgggttggaagatggggtgaccacagaagagggaagccgggggagttgagcattggtctgaactgtgggtggactgcctgggtgccatgagagaggccagtgtgtgtggggtggggaggaccgccacagcccccaggcactacctatgaagctctagcttctccctccatcttcctcccctttcccttccagcccctcttttccaggaaccttgccacgcccacacctacgccttccccttcccggctctcagatgatggtggtgtttatctccctgttcttgggagcccaaaaagaatggcatgcaggggttgctgcccatgcctgggtgctcctggggagtcctgcattacaggaagcagctgctggatctgctgtgcagtggggttgtcgtggggagaaccctccctgtcctctcctggtgcagcctccacgctatcagtgaggctcacctcacaaagatcttcagagagagggagggggggtgggaatctgagcacagtgtgagcctcccctgctcctgcctgcccaccccgcctgagggctctactcaccaccctgctcgtcagcacacccaagctcctgggctattggggctcctagagtgggctcatcagcagggttctgggcaatggtcagaatttgccatgcccctccttgtggtctcccacaagctgcaacacctgccccgcagctcctgcaggttcacctggaggaaggggtgttagctgccatgccggtgccagcacgcacgttcacacccacccccaccctcccccaccgagatgttgcacaccctaccttcatctcctcctggtcctgggccagcctgacgatgtcctcctctcccagtgctgcgtctctgacactgccccctggctgatgtactttcctgcaggaggacatggctcagatgctggggcccctcagacggcctggcagctccccccagcggtgccctagcctctcactccctatggtgtctgtctgtcctgagaggtggatgaattgaagctctagtttctct

SEQ ID NO: 1568 - DNA, 429318 bp, Homo sapiens
  misc_feature (66034)..(126033): n is a, c, g, or t
tcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataagtcttaagtcccctcccagatctgtgacatttgacaggtgtcttttcctctggacctcggtgtccccatctgagtgagaaaaggcagtggggaggtggatcttccagtcgaagcggtatagaagcccgtgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcatgacgagatgctgcacatgcaccacgcgctgaaggaggcgctcagcatcatcggtgacatcaacaggaccactgtcaccatgcccatgcccccgcccgtggacgacacctggttgtcagagcatccctgacgaacacaggtaccaaagactgccccccacggccccaaaatcccccacccgggatgcccagaggagtgccctgggggcaagtggcacaccccctcaccggggtggctcccacctggagtgacggggggagcttgacaaggagcactggctgccggggggggggggggggggtgtggagctgggatgttctcgctgctgggggcggggcttaagctctggcaaccgccttggggtgtggccggcactgcgctggggcggggtcgcccatctctcccctccctgtgcctcccaggtcgcccaagtccagcgtcaggatgcccaggccctgccatgtccctagcccggcctgggtggcagggcccagctcctgggcggcaggacccagctcctgggcttcctcctgccgggtccgcccttggggaagcgtgccccataccctccaggccagaggcttcccctgatccctttgggccctacccccctggtgctctcgtgccccagccggggtccccaggtaagtaggggctgaatgcggctgaagaggccgctggacaggcgtggccaggaaggaaatgggactggattccagagcaccacatctggccgccagaactggccgtctccatccaaggcactgggaccatgggtgccggagccacgtgtggccgagggctggcagagcctgccccccagggatcactgagtcctggaggtggtcgtttttgaggagggggctgtggggctcgtcccacctgccgccttctgtccagcacttgcatgacacttccctctattttcactcttggcggctgcccacacgttgcatttctcttcctttcttctcgctgtcctccatcctccattccgtccaactcctagcccagtcccgggggcgcctacttcaggtctgagagtctgaactccgagatgctctgggtgtgtggatttccttcagctaccctgatgtccccacttccaagtcctgactcctttgagccatcccagggggtgtccggccactggaccacaggagcagaggcgagtctgtgactgtgtgaccagcaaggtgtgtgatgtgtgcgtgagcgagcacacgagtgtaaagaatggcacccagacctgagctaggacagagggagcctgggggccacaggcaagctcatttcttctccacacccctccccgcccgaccctgtctaaactaatggggtagtggtagccgcaagggcagggatgggagtggctgaagcctacttcactcccaaagatttctaaggaaaatggttctactgcatcctttggctgggccttgttgacccgtgaccctctttcaagaacattcactctgatttccagtgtgccgtctccactggccacgttctctaaggaagaacaatagcatctgtttttgtttccaaatggctggagagtggggctgtgggaccagcgcccatatataaaaatgaagcagggattggggcttgccctgtgatgtgctgttgaccaagttagaggggtataggcaagcagcaaagtattgggcaagatcactggactgggagtccagagatgctgcttcaccctggggctttaggcaagtccctttccctcccagagcctcagcatcccttttagcaaattatgacattctgcctttctcctaggatggctgtggggatcaagggagacagtggccatagggatgctatgttaaccgcagatgcggctgtaggagcactttgctaactgccaacgtgagttcagactcttcaggctatttggcacccaggtctatggtgaggtgtgacatatgggatgtaaagtttgatgcctgctctgactccagtcttgctaacacacacacgaaacctttggcaaatcatgaccctgccttggggaaaagggcagtctgggagagcttcttcaaggcagcctggcttcaatgcagtccggggcatgactgagataggcatacgttgtgaggaactggagggtaactgggtaaagagctgcagtgtgggcagaggtgtagtgtgggtcacattgaggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctcttaggtggagaaatgacagccggacattagtgagcaagccctgtctccctgagcaggatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgcggcacgtgccggctggtgagggtgttgggcaccgggaggtggcggagagggcgacgtatgcgtgttgtttgtgggcatgtgttagagtgtgcatgcgggccgtggggcctcacagcatgtgtgtgcacaatctggcgtgtgcgtgtgtccgccacccccaggcctgccccacccatgcatgggacctgccatgtgatttgatgctgtctttcagaatcactatcagtggcccctgaggagcatcagccatggtaggtacatgcctcactgcctgctgcatgaatggtctgcccgccccgctgccccagctccacacagggggcatacctggagcctcagagccaggctgcctgcccctcccttctagagctgcagccttgctctttcctctttctgtccttgtgctgctggctgtctcacttccctccctgccagccacaggactcagtgccactgctcaaggtctccatggctgagcctgggggctcttacaacaggctccatgccgaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccgagagccaaatccactgcagattaggggtgatagtcacggtcccacgtcctctatctgtcagcaatccagtggtgatctaggataaaagcctgagagtcctatacacgcggtcatcccacaacacacttcataggccatgcaaggacacacagcccccttccctccctcccaggtaccatcacagctgctagcatgtgactgaaggctgggtccctggccagcactactgaagcactactgccagccagcaggctcacggaccttggcctgttgctcctaggggtcacctgtgctattcagccaaggagaccacagtgcttgctggcccagctgagctccgcctagcgagcccacctgcctttcctgccgcggagtctccctcttctgcttttcccagcaggaagggcccagcctcacctatgcaacctgcagccccccgccaaccagttgaggttcccctcttagacttataagtctatgggcagtggcatctagctacctgccctccctgccttccccagggtcccttcagtggaccctgggctttctgactgcccagagaggggcctctggcgctcactccagccagccatcccttacagcttcaccattttggttcaagcagtgttccttctgtcaggcttggtggctgttgggtggggctccccaagcaagaggtggccctgggccagtgggttggaagatggggtgaccacagaagagggaagccgggggagttgagcattggtctgaactgtgggtggactgcctgggtgccatgagagaggccagtgtgtgtggggtggggaggaccgccacagcccccaggcactacctatgaagctctagcttctccctccatcttcctcccctttcccttccagcccctcttttccaggaaccttgccacgcccacacctacgccttccccttcccggctctcagatgatggtggtgtttatctccctgttcttgggagcccaaaaagaatggcatgcaggggttgctgcccatgcctgggtgctcctggggagtcctgcattacaggaagcagctgctggatctgctgtgcagtggggttgtcgtggggagaaccctccctgtcctctcctggtgcagcctccacgctatcagtgaggctcacctcacaaagatcttcagagagagggagggggggtgggaatctgagcacagtgtgagcctcccctgctcctgcctgcccaccccgcctgagggctctactcaccaccctgctcgtcagcacacccaagctcctgggctattggggctcctagagtgggctcatcagcagggttctgggcaatggtcagaatttgccatgcccctccttgtggtctcccacaagctgcaacacctgccccgcagctcctgcaggttcacctggaggaaggggtgttagctgccatgccggtgccagcacgcacgttcacacccacccccaccctcccccaccgagatgttgcacaccctaccttcatctcctcctggtcctgggccagcctgacgatgtcctcctctcccagtgctgcgtctctgacactgccccctggctgatgtactttcctgcaggaggacatggctcagatgctggggcccctcagacggcctggcagctccccccagcggtgccctagcctctcactccctatggtgtctgtctgtcctgagaggtggatgaattgaagctctagtttctctacccgctccttcaggtccaccttctccttccataaagtcgctgtggagccaaaataatggggtcacatgtcaggagtcacctgccttgtcctgcccccccgccccccttgttggcccatgccaggacctactcacctgcagcttctccatggccccctgcagggcccggtgggtctccccaaacacagactcacccccactctctggggctggggccgctacctctggctttttctgggacgaggccactgggtgagccaggggctggcagcacaccctttgttcctcctgggcattggctccagcggagttgaaaaatgccacctgaagacaagaggtgagtattcttgtaggggtatacacataacaactggggcaggcagatggagcatagccccttcatttcgggcctcacagagtgcacctgttggtcacaggtgaaatggtgtctgaccactggctcccagaagcagagaaagtccacagaagtcagaaggcggggaaaccaagaacataagggggtttcggagggaccacagaggaaggtggcaaagtaggggcagggaaagtcaggctcaccatggcctcccggctctccaggtcccctgggatgttcggcatgggccgaagcgcctcctgctcactgtccagatgtcctcctccatctcctgtggggggtggccagaggggtcctcagacaacccaacaagggaggtacagtgggcccgcctctgcccccacactcactgtgtaaccttgagccagcccctccccagaggggaatgagctgttctttattttgaattttaagaaccaagatcttgctatattgcccaggcacagtcccactaccgattggtgcaggaattctgacctgctccctttctgacctgggccagttctcccatccttaggcaagccgatgacctgttcccaggaggtcaccatactgatactgaacttagtgcggacaccttgtcggcataatgaccgacacaaaatgcttaaaaggtaacctgactctttgttcagggctcagtcctttagatgttaatctgactgggccggtgcacctaaataatatatatcctcctcagtctctctgattcctaaattatgctgctgtacggggagagaggcagcagggtagtggagtcataccaagcaacaagacagggtagtggccaggcatggtggctcacacctgtaatcccagcaatttgggaggccaaggcgggtggatcacctgaggtcaggagttcgagaccagcctggccaacatgatgaaaccccatctctactaaaaacacaaaaattagctgggcatggtggcaggtgcctgtaatcccagctactcaggaggctgaggcaggagaattgcttgaacccaggagatggaagttgcagtaagccaagattgtgccattgcactccagccagggggacaagagggagacttcacctcgaaagacagacagacaggctagtacgttttccacaaatttcaattttactctcttcccccaccacacacacacacacacacaaagcatttgagggatgggaggaagaaactgagatcacagggaaaattgtaagagacattcagaaggacaggtcttagaaatttactagtttgggggggaggtcagaacaggtgtatataaaagaatattaagacagttcccaggtttaggcatatgtgactagatagagtgctaggagatggatacgtgaaaatttaaatatcatcattttgaacacccatgtcactccaagtgagattccctaaatatatgatatacagacagatatatgggtttgaaactctggagatgaatacaaatttaggagtccctggaacacaggtcatgacttaagtaatgggagtcaaagattactcagagaaagcacagaatgagaagagaagaagtaggacaaggaagaagagatcggaggagaccaagaaagggtgataagatcaaaacaggagaaaagaatccgacagaagtctcatttgattatcatgtcccttcccagaggacagggacatgtcttttttgtcttttatacccaattatcacaggtcctggtgcagcagacacacagtttttttttttttaattgtgttgtactactcacagtttcctgtattcaccaggggagaaaaaagtaagtataaagaagcacagacacagatgtttttacactgtgtactaaaggggtcagattatacacaatattttatgccttacttttttacttaatatatcttagaagtttgcacgtgctcttatggaaagactggctgcattttttggtccacaacagaacaacagaatattataaaacggtacactataatttttatttaaccaactctttattggtggacattaagaatggaggaatgtttcaacaaaggaacaacagtatcaaaatactgcagaggggacaatttggggactaagaggggagccactggatttgacaactaggagataaattttagtgcaacgatgaaggcagaatccagagtataatgagctcagtgaaaaaaggtgaagacatgtagcttattctctcaagaaactaggctatgataaactggcagaggctctaagagtgggaggtgagttgttttctccttcatgtaaatatatttaccttttaaacactaggcccaattttatatcctatttcatttaactttatgaacatatttatgtatgtatgcatgtatgtatgtatctcatgtggtgttttagacactgaaaaataactcatttctattataaaactgatatctttagatgttcagaagcaacttcctaaaaggaggtagcagtaatggagctatgtctatcattctttcccatcaacccccttgatggagatgtaaacatgtgtccatcaagcctttaatttttacctcttatcttcatggctctccatataaaacttaactcttttttttttctatttgtatacgtatatttatatgtatatctatatcgagagagagagagagagaaagagtcttgctatgttgcccaggctgatctcaaactcctgggctcaagcaatcctcccaccttggcctcgcaaagtgctgggattacaggcgtgaaccactgtgcccagcctcagccttaactcttaaaatatcttcaaaccaatattcttctgttctaatttttaagaatagatgtgtttaaaccaactaacttattttgacaaaaattggagttaagactcagacttcctcaaatagttctcctaaaaccatttacagaataatctatcttttcagtattaagttaaaataccaccttttccttatactaaattctcgtttgcatgactctggttctaaacttccattgcctttatctgtctggcccagggatagtccacaatattttatttactatctggttgaaagagtctatactttattaatttttattacttattcttctaaacaaattttagagtcgttttgtcaagtgtcaaaaataaatctgccagaatttgtactgaaatttgtgtgtgtgtgtatatatatataatacacacacactatatataaaatataaaatgtatatatacaatttatatatataaatatttataaaatatgaaatatatatatatacacacacacttttctagtttttttttttttttttttttttgagacagggtctcactctgtcacctaggctggagttcagaggcatgatctcggctcactgcaacctctgcctcccaggctcaagtgctcctcccacctcagcctcagaagtagttggaaatacaagtgtgtgccacagacacccagctaattgtcatctacccgcctcagcttcccaaactgtttggattacaggtatgagccactgtgcccagcagaaattacatttacaaattaatatgaagacatggtgataactaacatatttataacatgaaatctgctcatccaggaacatagaatgcaaatctttcattccactcagcaaaattttgtcctgtccttgataaaagtcctgcacatctaagtttattcctaggcatttaatttttgctgaaatacctgaaaaaatacttcatcactatatcttctatgtgattatagctaacattggggaaggctattgatttttatataaaagaacttttaaccagtaatcttaaaaattgttttttctcagttggttcctttggatatttttaggtaaacaatcatgtcaactgaaaataatgattatttttctataaagactatgacatcacaggaaaatacagtaaatactttttaaaagaatataaaagggccaggcacagtggctcacgcctgtaatcccagcactttgggaggccaaggtgggcagaccatgaggtcaggagatcgagaccatcctggctaacacggtggaaccccatctctactaaaaaatacaaaaaattagccgggaatggtggcgggcgcctgtagtcccagctactggggaggctgaggcaggagaatggtgggaacccaggaggtggagcttgcagtgagccgagaccacggcactgcactccagcctgggtgacagagcaagactctgtctcaaaaaaaaaaaaaaaaaaaaaaaaaatatatatatatatatatatatataaaactatagagaatatgacctcaactattaagcatatgtgtaagggttatgtattttaatagcaaagaaaaaatatatactggtagaaaatgaccatcatgtcaacagtcaatagtggttatattagatagagaaattatgggagactttaatttttttcttttatcttttctgtactttaccaattttctcaacaatggttgcttatgagttttaaaattaaaaaaaggttttaaaaatttttccaacatggaaagttatatttctttatatactaaaacaaaaacaaaactttctatttgaatacctatggcaaaaccctatctctacaaaaaatacaaaaaattagcaaggtggggtagtacacacctgtagtcccagctactctagaggctgaggtgggaggatcacctgagtccccagagaatgaggctccagtgagccgtgatcatagcactgcattccagcctgggagacagagaaagaccccatctcaaaaaaaaaaaaaaaagaaagaaagaaagaaaaaagaaatatccacaatgatctgaaatgcctatctgtatgagactgtcctttgttcacattttttcaagcaaatatcacacaataaattgaatgcaggtacaaatgacatatcaaacatcaaagaaatttgcaaaagatgtaagactgtactaccttgggtttagaaattttcttatcataaaagcatttataacaatattttgtgagcttttaaggaatattttaagtatttctgatttaatttctagtgataaataccaatagatataacccacatacacaaaagctccttgggccctcaatatacttttaagagtgtaaaggaatcctgaccccaaaactttgagaactgctgccttcccctctactttattccttccctagaatttcttccttggaagaaacattcctttgccattctatgttaacttacacagttccattgaggccagttttgctacctctctcccatctttccacatccctctcttgacacaaaacctgaccaaaggactctaccggcccgccccatttccagtgattagctgtcaggtgggctaagccaagaaaatctgggttttccctgagactagacctctctttctgggagatacggaatcacagggacaaggctggccctgtcagaattcatcttgtctaaatgggaagaggttaggcaagtttctagaatgccagactgctttctagaaagtcaaagataattatactttctgccacgactgtgaaaatgcccatttcattgcacgctttctaacatttataccaatctgataaataaaagctggtacctagaagaaaaaaaggctgggtatggtggctcatgcctgtaatcccagtactttgggagaccaaggtgagtggatcacctgaggtcaggagttcgagacaagcctggccaacatgatgaaaccccatctctagtaaaaacacaaacattagccgggcatggtggcaggcccctgtaatcccaactactcgggaggctgaggcaagaggatcacttgaacctgggaggtggaggttttagtgagccaagatcatgccattgccctccagcctgggtgacaagctgagactttgtctcaaaaaaaaaaaaaaaaaaaaaaagtttccatacaatataatttgttccatctctaaaaaccaattcagcaataactgaaagccaccacttggaaggtttcaaggatttagctctacctgttgatgatgtccaaagcattagttaaggtagaaaaaaaatacacacacacacacacacacacacactcacccctatgtagtcagtaccaggaaacacgaaagactagatggtacagtcatccaacacaaagcacacaataactgaaggcactgtagaggagtaacttatgacacagatctacaatattgagtgaaaatgcagattacaaaaaaaaaatctgattttttaagggagagggaacacatacaagcaaaggagaaaagagatgagcagatgactgaaagatacaaaattctgatagtggtacattctgagtggtagaattatcagtattattttctagttttgcctaaaaattttctaaatttcttaagaactttttgttatccatattatcaaatatccatcaccccaggaaacttaaccttgagcacaaactctacaacaagttcaatgtttgttcagtttaatatttaagagacaacctattttgaaagacatctaaaatgatgaccaatatttaaacctatgcattaatatttttcaatcatatccttcacattttgtaattttgataaggttaagctttagatccatcttgaaaagataagttttctgtttgtctttaaaatatgacccacaatatgcctgtttttaaacagtgaatgatgctctaaaatcacaatataaattcaggcagtgctccttacatggaaagtttaagtacttctaacactgctctttttcacttgttatgaaaacacagaacaattatctaagcatctaattattcaggtcctttgtttctcctccaatctattagttttatagtaattttagggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttctgtacctatttttctccataaatccactgagaccaatgtgtggctctatctcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattcttctgaaggctggttatgggacgcattaccttcatactttgctgtttaagaaatgtggggtggagaatcaagtaaactgatagaatttccatataaaattctaagtgctctgagaacaaaagaaacttaaaatacacacacacacacacacacacacacacacacggttttccctactaatcattttaaactaaacaaccaagttgctaaaccagagcccacaaaagcagagtcaaagttctaacacttggtaaaagaaaaatgcacacatacccctgtgagctaaaaaaaaaatgcttaagtattcaaagacagcaattacagctactgagaacatcactgtaagcaaactgaggcagagaaaacaaacgtgctgatgaggatttgaaccacctaagctgcagaaacccactggatggtttcctaggttccgagttggcattatctttcagaacaatcttctagaagagatcacataacactgttacaaaggatctggagaaagggaccctggcttcatcactgtggctctccagtcatgctttacatttggcagtgactatctccattcaactcaattccctaaccctgaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggagcagaaagtttaatagacaagaaagaagaaaggctccctgcggtacagaaaaagggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttgccagcctgtagtcccagctactcaggaggctgaggcaggagattcacttgaacctgggaggcagaggctgcagtgagctgagatcacaccactgcactccagcctgggtgacagagcgagattccgtctccaaaaaaaagataaaaagaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcctaactactaaataaaagctaaactactcacttcctcctagattcagagagagctccaacattttctaaaatttggtatcttgttgttggggtaggcactttttggcaataatgaatagacatttaattagccaatcaaaaaaacttattaggtacagtaagttcctcttcaaaggtttaacctgttcaacttccttgttctttgttcctaagaacaatttccctgtaccttctcacccctatttacctgcttagttatctgctcagttacctgccttgtaaacaactcttcccatcagtcccaacctgtaactcacattccctctcccttccttattagggagaatattcgcgatagcaaatcaagtctgcttagattgtgtagtccgactccagcccatgtgggaatgacagagaggtagggactgcgttagggatataaactcctgctctatcccgctcggtgtgctcttgcattcgtgactaatgcaaacagcagtcttttgcagaagtaagttgtcttgctgagaaaactttttttcctgagtgctggttcttccttgcagcactgatcatttgtttcttttttctttcttttttttttttttttttgagacagagtttcgctctgttgcccagggtggagcacagtggcttgatctcagctcactgcaagctccacctcccaggttcacgccattctcctgcctcagcctcctgagtagctgggactacaggcacccaccactgcgcccagctaatttttttgtatttttttttttttagtagagacggcatttcaccatgttagccaggatggtctcgatctcctgacttcatgatccgcccacctcggcctcccaaagtgctgggattacaggggcgagccactgcgcccagcctgatcatttgtttctaacaatctgggggctcgtccggaattcccattctcctctgagaaaagggtctccagtcaccaatagtgaggagaagcatcccactgcctcattgaggtggcctcatggtgagggatcaggacccacccagtgtgatgaataaacccggactctcagcagtctggaaaggaacagaccaacaacttaagagaaaaggatcctcacataccatggtgaccaggtaactatgtgcacagaccaacgtaagaaacatcacaagagcgacaaagtattttcttggtggttgggatatcttggagattgaaagtgtgtgttgagactcacaattgagtgcaaagcaagtgttcagtccagatctgcagttctgtggtcaccttatacagcttaaggtagcccttctgtaaaggagtctgggtcaggggtttctactgaaacagccattgctaagaggaaaccaatgttcccgtgagggaagcagccagagaaggatgaagcgaaaggagaaaagtgcaagaaacctccagcaggggggttgagcctcggaaaggaaagggaaaggaaagggaaagggaaagggaaaggaaaggaaagggaaaggaaaggaaaggaaagggaaaggaaaggaaagggaaaggaaaggaaagggaaagggaagggaaagggaagggaaagagaagggaaagggaagggaagggaagggaagggaagggaagggaagggaagggaaggaaaggaaaggtgagaaatctccagtaggagaggttgagccttatacaaacctctcgtaactgggaagaaatttctagtaggggaaattgagcctcaccccaatcccttttcaagatgggaaatacctcaagtaatgcaggggagaaaaaggataaagctagcaacaataacattcctcctgatagtcccctagggcttatgctaaaatattgaaaagagagtgaaaggactaaatacaagaaaaagcagcaaatgataaaatattgttgtttcatttggactcaggaatcaatcctgaaaagcaagtcagaaattaactcctctgagaaagataaggtccctgttcctagacagctcaccaacacatggaacttcctccaccaccttcccccgtccaatatccctaacctccttccccctcaagcagaagcagttgtcccagacccttctcctacccacattgttccccctctttataaccctgcctcttgggaattgtcccaacagcctgctcactatcaccctaagtactcttccctgaaaggacttcagtgtgagatagagcaatgtaaaagggatattcagaacttccccttcccctctacctcgggagaattagctccacctctcttcccctgaagagaggtgtccctacgaggaggaggtattcactttgtaaatgctcctttaaccagctcggaggtccaaaacctaaaaacagagttcaagccacactattagacaactccagtggaatagcagatcgaattaaccaatttctaggaccacagttatatatacttgggctgagttaatgtccatcctaggcatccttttctcaggggaagaaagaagcatcatctgtagagctgctatggtagcctgggaacatgaacaccctcctggccaaaacattcatgcagcggatcaaaaattccccaaccaagacccctgctgggacaataataacgcagcccactgaagaggatacgcaagaacttagggaaatgataataaaagggattcgggagtcagtactccgaacccaaaatcttactcgagcattcgacatacaacaaaggaaagatgaagggcctatcgaacttttagacaggttgaaagaacaaatgagaaaatatgctggcctagatttagaagatcctcttaggcagtgaatgttaaagcttcattttgttactaacagccagatatcacaaggaaattacaaaagataggaaattggaaggaccatcccacgaacgagcttcttagagaagctcagaaagtgtgtgtaaggagggatgaggagaagcaaaaagaaaaaatgaaaattatgttatccaccttccaacagggggccccaaaggataaaacacaccagtattactctctgttacccagagacccacacactcccaaacaaagcctcccgagagccaaaacctataaagatcctaggcccccacttcctaagccatataaagaacataaggagacaaagccgagaaacccaaaaatagagagaagagacagaatcaatgcttcaattgtgagaaagtaggccacttcaagaggtattgtcccaaattaaaatcagaaagagaagtcgtcccacttacgacctttgaggaggaataggggggttaggggctctgtctcttttaccttgaatcccaccaagagcccttgataaatttagaagtggaacccaaatccgagcttatgacctttttagtagactcaggagcagcctgctcctctgtttgttaccttcccccacaatataacctggtcctcagaggagcttgtagtctcaggggtaaaaggagagggaatcaaactaaaaattttaaaagaaacagaaattagatgtaaaaactgctcagctaatgttgaatttttgttaatttcagaggcaggaactaatctattaggaagaaacttaatgttaaaattaggtataggtttacgtattggctcagaaggattctacacttcattaaacctgctcaccactgcagaagaaacatacattcatcctgatgtttgggcaagggaaggaaattggggaaaactccaaattccccctatacatataaagttaaaaacccctggagaaatagtaagaagaaagcaatatcctattcctttagaaggcagaataggcctgaaacctgtaattgaaagcctcatcaaggatgggctccttgaaccctgtatgtccccttataacaccccaatactgcctgtgaagaaaccagataggtcatgtcgactagcataagacctctgggccatcaaccagacagtctagactacccatcctgttgtccctaatccttaaaccattctcagtaaaattccatatgaacatcaatggtttacagtaataggtttaaaagatgccttttgagcatgctccttggatgaggacagctgagacatttttgctttcgaatgggaagatccccattctggatgacagcaacagtatcgatagacagttctaccccagggcttcacagattcccctaatctctttggtcaaattctagaacaagtgttagaacaagtttataccccaaaatgtatatgtctgctccagtacgtagatgacttattaatatccggttaggctatagaaaaggtatctgctttctccgtccatatccttaaccatttgtaaggagaggggctatgggtttcaaagagaaagcttcgattcatagagcctgaagttaaatacctaggacacttaataagtaacggcaaacgaaggatagggcctgagagggttgaaaggattgtatccatacctttgcttaagactaaacaagaactcagaaaattcctagggatagctggatattgccgcttatggattgactcatatgcccttgtcataaagcctctctacctaaaaatcacccaagaaaagcctgaccctctcctctggacttctgaagaactccaccaggttgaggagctaaaacatctgcttataactgcctctgttttagctttgccttccctagaaaagccatttcacctttctgttaacataaataagggggtagctttaggggtccttacccaagaacacggaggtcaccagcaacccatggatctcctatccaaaagttttagatccagtaacctgtggatggcctgaatgtttcaatccattgcagctaccgccttgttaactaaagaaagcagaaaactaacctttgggggaaagttagttgtaaacatgccccatcaggttagagccatcttaaattaaaaggcaggaaggtggcttactgacttgagaattttaaagtatgaagctatcctgttagaaagagatgatttaacactaaccactgataattcacttaacccagaggtttcctgactggagatccaaatctaaagagacctgagcatgagtgtttagatttaatgatcatacaaaagttaggcctgatttaagagagaccccttacaaaacggggcagggcttctttatagatggctcttcccaagtaattgaaggaaaaaggcgtaataggtactcagtagtagatggggaggcacttgaagaagtagagtcaggaagcctgccaaataattggtctgcccaaacatgtgaatgaattgtttgcattaaatcaagccttaaagcacttgcaaaaccaagaacggactatttatactgattccaagtatgcctttggggtagctcacacctttggaaaaatttggactgaacgagatcttattaatagcaaaggccaagacctgggccacaaagaattaatcacccaagtattagataacctgcagctgccagaatagctattgtccatgttccaggacatcagaaaagtctttcttttcaaagcggaaggaataacctagcagatcaaatagccaaacacactgccgtttcctctgaaaatgcctgtttttcacttagccccttgccttcctccctcgactgcagtccccatcttttctcccgctgaaaaggaaaaattaataaaaataggagccaaagaaaattcagaagggaaatgggtgtcaccagaccaaagagaaatgttatccaaacccctcatgagggaaattctctcccatctgcatcaagggactcattagggacctcaagctaagtgtgatgcagtcctcggggtctacagatgtataggaatttatattttggcaagacaagttacagatagttgcctagtatgtaagaagactaataagcagatcctcagaaaaccacctgttggagggagaaatccaggattaaggctgttccaaagtgtccaaattgattatgctgaaatgcccccaattggtcacttaaaatatttattagtgatagatcaccttactcattgggtagaagctattcccttttcaagtgcaactgctagtaatgtactcaaggcattagttgaaaatattatacccaggtttggattaatagaaaatgctgattcagacaataggactcatttcactgcacatgttcttaagaaactagcccaagtactagatataacatgggactaccataacccctggcacccaccttcatcaggaagagtagaaagaatgaatcagactctgaaaaaccacctaaccaaattagtcctagagacttggttgccatggactaaatgcctccccatggtcttgtgaagattccaaactgcccctaggaaagatgtcggctcacctccttatgaaatgctgtatgagttgccttatctacactccactgctgacattcctcgttcgaaacaaaagatctgtttctcaagaactatatacttggtctatcctccactttctctttccttaggactaaaggcctcttggcacatacaccaccccttaattttaccaattatatatattatatataattttatatatataaatttctatatataaatatataaaatcatatatatgatatatattttttcatatacatcatatatatttacaaaaattatatatcatatatcatatgatatatgagatatatatcatgatatatatgatatatgatatatatcatatgagatatatgatatcatgagatatatgatatcatatgatatatatgatatagatatcatatgatatatatataatatatatatgatagatatattatatatgatagatatgatagatatcatattatatatgatagatatgatagatatcatattatatatgatagatatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatattatatatgatagatatgatagatatcatattatatatgatagatatgatagatatcatattatatatgatagatatgatagatatcatattatatatgatatcatatatataccacatacatcatatatacatcatatatacatcatatatatcatacatatatatgaactttccagaataggtatatcaataaagacaggaagtatacaagtggttgccacagcctgagaggagcagggaatggtgagtgactgctaatggatatggcactttttttggggggtgatgaaaatgttctggtcagacaatggcaattacaaaactgtatacacacgaaaaaccaaagaatcacacactttaaaagggaggatttagctcggcatggtggcatgcgcctgtactcccagttactcgggaggctgaagcaggactgcttagagcccaggacttcaaggctgcagcgagctatgatcgctccactgcactccaacaaggatgacagtgcgagacccgttttctaaataataataataataataataataaataacccaaggtacccagttcacatgcaaaaccactggtaaacataaattatctccaagtaatctagaaagaaaatgagcacataagacgtcttctaaaaacacacatatatttctttacatgttacatttaacgtaaaaatcagctatgcagaagttacatgaacattttatgttggaaaggtaaatgactattattaatacagaatggttaagtacatttatgtttttatgtacaaacgcataaaaggaaaagcatccttaaaataaacaccatcaatggctcctcggtggtcacaaaacaaaatcctcacacctttgtcttccttcacaattgagctttatccaccttttcaggcttatctcccattattacctgacacaaacttgggtgggccagagtttccactgaccatcccccgactattcatccaacactatgttcactgcctcccattcctgaccatttgccttttgtcttcaactaattctggggacgttttgtccaaataaatgatccatattcttgaaggctggaatcaagtcctattacaaatatattttctcaccctctccagagcatagcaacccagcatctactagcctctcacagctctaaccatccacaaccctaagctggcttctcatcaaacgggtacttttcaccacccaaattcaattaattcactcttacaataatgaagaatagtcgcctacagcctaccttttccagccttgattcaatcatttatcaattttatcttcaaagtccctcacttcagggagatgatatatcagctttcacccagagtcctaaagaaaacagcactcttgccaatgacatagtgccacctagtggcaacataaggtaaatcacagtggcagtagaaggatctccacactacttttacaggaatgcactgcaggtaaaaaataagaagctacagtactgtttggcaggacaatttgtttcatacgtgcatactatcgccctgactaaattaactcgcaagtcttacaggtattatttgttttcagttccatgcacagattagccatttagtacttactaaatcaaactcaatttctgaagtgtcttacaccaatatattcatgcacatatggttaaaattttccttgaggatctatcatgtgagagtgtggcttattataacaagtaaacagaacaaataaatacaaaatgaaaagaaatcgtatgatttactcgcatataagggagcttgttgtggattaagtttcatgacccaggacactgaaacagaaatggaataaatgagaataaaattaaaagttgtcatcaaaaatatagaagccatctaaagacctaggtgtcaagcatagctctatgagtacaatcccgtgcctgagattaccatatgcccagctgtatgctatacactaagagatttaggaaggaagcggggtcagggattgaccccagactccatcttttcaagtggggaagaaagatcttccgattgaaaaataaaggcaaaaaaggcttcaccgtcacagaagtttcaacaaccaacaggatatttaaaacagttatcaaagcaaaaccattgtatgttcacttacatttttacatagtccctcaaactcacaaaatgctgtttactcagggacttcttccggtcttactagggagcctggaaagtgacgggaggattgcaagggaccactagaaccctcttcctcaattccccttctctgagaagggaggctacagcttgcctctctaaccactaaaaggcatgaccctcctcaaagttaatagccggattccctgatagatattttcactaaatgaattctcataaaactctcactaagatttagagaaggcttccagggttgaattcctgaacattaagaacagcatgttttttaaaagtttaacttggtgattggaccaggacttcatctaggctatgaatgctcagaatggtaggtcctttaccaaacagcttgagtttgtgtataaagtgatctcatcctcttaagagtcagagaaacagaaccaagcgacttcactataatttgatctgaggaagtttcttactcacaataggtaaatgaaggcacatactaaccagcaatataaacaacaatatcaagtgtcattcacacatgcaaaaaacagacaaaatcccaaactctgtgttctaacaaatcgcaaaaacctcactaacaataaattgaaatgaccaaatgtttggactgaaaagcaatgccttggtagcctagccatgcctaactcaaataacagaaccatctcgatgttaaaatcctcacagatcaagctgtgtatgtctcgggtcaagacttcgccaaaaagcagtgagcacacacttaagagggaaaaaatctacctcagcctcctaaatgcaatcatctctacacgagttgcaggccccaagcttcaacgtgttctgctggacaacgcagtagaaagctgacaagcaggtggccttcccacactgactgaaccacctccatgcccatgtccattcattttcttgcccaccccatgtgctataacagacctcctggctcagggcactctttccttcctgactgccttcacttaatgactttgtacttttaggtgcaaaaattatctgcagaaatccacactgaaaaccaagcttgagaaaggcagcaataaccaacatttttacaagaagaacaaggtcaatatcaagcccatcagattcaaatagcaagcatggatgaaaatgaaagattgaaaggcttgagtgccttcttaatgtattaaatatccatttaatttacaattaagctcactgtgctcactggccttttaatcagctttccaggtcctgctcagacttgcctaggacatgggaatgaaagaacctatacatttatggaccaatctaccttaactaacttgtcaagtgttcctgcatcaagcagaagaaacatcagtgaaactgatacaggaattaaccccttgttaatccataaaacttaaaggagcgggatccaatcttctggcttccctgggccacgctggaagaagaattgtcttgcgccacacataaaatacacgaacactaataatagctgctaagctttaaaaaaattgcaaaaaaggaaaatctcataattttttgtttgttgtgaggtggagcctcactctgtcacccaggccggagtgcagtggcaccatcttggctcactgcaacctctgcctcctgggttcaagccattctcctgcctcagcctcccgagtagctgggatgataggcgtgtgccaccatgcccagctaattttcgtatttttagtagagacggggtttcaccatgttggccaggctggtctcaaactcctgacctcaggtgatccacccacctcggcctcccaaagtgctgggattacaggtgtgagccaccgtgcccggccaatgttttaagaacgtttacgaatttgtattgggccacattcaaagccttcacaggctgcatgcagcctgcaggccgcggttggacaagcttggattagagaaatctacagagacaaactagtgacttagtagccctctgatagctcatgatttgcaagaaacttaggatgactatgtgtaaagaccacaaacatcaatttaactgaatggttcccgccacactggaatgaggaagctgagcaaactcagaggactctaagaaagggctgatgtcatctgaactgttcggaattataaactcctctaaacatgtttcaaagccagaacttgtaggagttgttctgatacacggattaaaagagggatgacaaagtgtctgtcccccacactggtcaaagggacaggtcattgttatgctggcaatgcaggctgctgaaaagaatgtatctgtcaaaagtaatcaaagtaatgaccccagaaggctccagaaacagactggtaaattcaggttgctttcagacttccacaatgctggcacacaaggggaaagacaaaactaacatttacagagcattatatttgatattacatttaatccccattaaaaagatactatttcccgtttcactagtgaaaaagttgatctttcaaaggttaaattatttaacaccaaggtcaaagggtaagttggagagaccagattcaaacccagtctgacattaaaacatgtgttttccccccacatcgtctcctgctaataacctcaaatctaaaaactgacttgccctacaccttgagccccatcctacaaactctccctgacgttattaattcagctgtcactgtgcacctacaacgtgccagacaccatactcctcaacactctgtaggcacagaaggaacagataaaaatccctaccttcatagatattattctaggggtaacacaggtaaataaaacattaaaatagttttcacatagtagcaaattccatatagcaaaataaaacagaagaaggaatagcaaatgagggagatgccctcttaaacatggtgctgagggaaggcctccctgagaaagatatcatttaccccaaaaataaaaaagcaagtaatagaaaaaacaggtaaaaggtgttctagacacttaaacctgccacattgagaactcagggttctgatgcaaaacctcgctgcatagaatgcattaacttatttttatacatttaaacaaacaaactctacttaagaactgtgttctaaaggaaggagcatattacaggaaggcaatttttggtcagagtagacacacttaaaaactaaacctattgaaagaccaagaacaactgaaagtctttgctttgtcagatttttgaccaaaaggaaaattaaagaaacacaccgtgcccatccaatgatttcaccaaggaattttaagagagaaaatcctacttcttcctcacccagtagccagtgaaatgactgagcaaattcacaagttcactggggctgctttcatgtaacacagggacaacacatgacagacacagtggaaccctacaggttgcctagtatttgaaagactgtgaagaggaggagatgtcaaaattcaaagtcttaaatgatgtagttttaagtatgttcagcaatttcaccactcagtagtaaagccagctacagttgaaagcaatcagaaatttgaggggtgtgaaataagcagaagcacagaagttaaggatttgtattcttcccacattttccactttattttatactgctgagaaaaaacaaatttaatagttttctgctgtataagagagacacattcactttatgtcacagtaagagtcactcaattttaatacaactatctcaatgtataaattaacattctcccccctgcccacacatagtaagtctcttatgatgttgctgattagagaagcaaaagttgccgctacaattctcttcctgcattttaatataaacaatcatcagtcttttcttcatagagtgcagtgtgggcactatcatcagaatgtaccagcactgggtgtgcaaagtttacaaagattagcaagagcaaaagtgttgagatttttgaaattcatgctgctgcaaagaagtatgtaaaaactcactcaccatagaggaccacacagaaactcaggcatgaagttatatggctgtgtgagtggtttgggagaaggaacggaaagcacttccaccaacctatatgcctgagcaaattaatgcaaaacctcagaagctacaaaaaagtttatctacctaaattaaaattggtgtccacagcagtagccagcaaaatgcctgcgaagcgcaaagtggtaaatattttagggtctgtaggtcatatggtctctgttaaacaatatgtaaatgaatgggtgtggctgtgttccaataaaacttcatttataaaaagaggcagcatggtacatccagtcagcaagctataatgtaccaacccccggtctaacactaaccaaatacctcttaataagccaaagaaactgtgtcctcttaggccggaagcggtggctcacacctataatcccagcattttgggaggccgaggcggggagatcacctgaggtcaggagtttgagaccatcctggccaacatggtgaaaccctatttctactaaaaatacaaaaattagccaggcgtgctggcgggcgcctgtaatgccaactactggggaggctgaagcacgagaatcgcttgaacccaggaggcagaggttgcagcgagcctagatcacgccattgcactccagcctgggcaacaagagagaaactccgtctcaaaaaaaaaaaaggaaataaaagtatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagatttcaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacacttttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcagtaagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggcgggtggatcacaaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatgtgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaaggggggacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgtgcctgcactatgttaagaccactggcaaagagggtacaaagttaaataaggtctatcacagccctcaaggagttaaaggactagaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaaatgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaaaaaaagaaggaaaatttgagggtttttgattttttcaacttcacataccggtttgcctttgcaaaaaaaaaaaaattgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgctccggctccgcgacagctctgcacgtagccccagccaccccgcgcaccggctacaagccgcccgggggtggccggggcacgcaagagggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaagtgatcacagcagggtggctggcagagactgctctgggaaatgcccactcacggtctcctctccgccctgtttctagaaactgccctttctctgtgtgctcgtggttacctgagctgtagcatttaaccacacatcgtgaaatgatttactcctctatttcccccacttcaactcaggaagtggggtttagtcttgtgtgtccacagcctaggacactctaaggtattaggtattaaatataggtattaaacaagtgttggatggatgcacggcgctatggcggaatcacaattgtgacagtgcattccgtgaacttttggctactcgatcaccacagtcgttccgtgttcaagctgcaaaggacctcagaaatcatcggattgctttgagaaacaaaatgtggtccgtgtaccaacggcggccgaggagaatatattagttggtacacggagaaacttcttttttcaaatagttaagtgttttagtgctcattaggagggaaatgcctatcacgtcaaatcattgtttcattaatgttacttcttaggtcaaataaaaagtggcaaaaaacaagtgtatttcaagaaaagtgttaagtgaaacttgagacactttatatgcagttcaagaatgtaaaatactagttgacagtgcttgaagtaagaacagttggttaggtaggaggagaagattattggctgggaaggaggaggagggaaccctctgtggtgctgattctgtattttgacctgggtgatggataacaaaagtatgtacatcaataaaaaatacatccagtgcactttagattagtgcactttacacattttatacatgtatttttaatgtcaattttttaaaaatctggtatggaatatacccccacaacccccccccccccaaaaaaaatgcaaagatgcaaatgactgccatttgggaaacactgatccaggcaggctcactagcagtgaccaaacacctgagaaagggtattgtgaatacctgatgtatgtgccaggaacttccatggttgaatagctccaaatctcagaaatgctcctaacctcgtgttgagctctggtgcatagatatattttcttttctttctttcctttttttttttttttttttgaggcagagtttcactcttgttgcccaggctggagtgcaatggcacgatatcagctcactgcaacctccgcctcccaggttcaagcgattctcctgcctcagctgcccgagtagctggaattacaggcacatgccaccaattccagctaattttttgtatttttagtagagacagggtttcactatgttggccaggctggtctcgaactcctgacttcaggtgatccacccacctcggcctcccaaagtgctgggattacaggcttacaggtgtgagcctcagcacccaacccagaatggcttaaaaaaaaaaaaaaaaaaaaaaggccaagcatgcccagttcttcatgtgaaattatttctgtatcacctcatcatgctgctcaccctcttccactgttctctaatctgtccttgttgatatttaaaagctggcacaaggccgggcgcagtggctcacacctgtaatcccagcactttgggaggctgaggagggtagatcactagagcccaggagttcgagaccagcctgggctacaggtgaaaccccatctgtactaaaagatacaaaaattagccaaacgtggtagcccaaatcccagctacttgggagaccgatgtagaaggatcgcttgagcccaggaggagaggttgcatgagccaaatcagcagggcagctgcagagtggggtgcaaggtcctcaacccagaggttccctaggccccacttgccccagctcatgagagcctggttctgagctctgccaggactggggctcagcactgcccatgaaaacaggcgtggcagggaagaaaatcataaccaaatatttgtagtcacctctctcctcccttctggaaagggaggttcccaggtttgtgggctctttgcctcctggacattattgtgtagtgaagggagaaaggttgagatgcagagttggagaaactaagagaggccgaactggtccatttgaggaaagatgactgatcccagaaggggaggaggggacaccctggggaagcaggggacttcccacgtggtcctagaaggggagggcaggatatagaaagtcagagcatggttttgagttttggagacaacaagagaaaagagggagggatttggacaactatggagaggactgggctgtggagagaaatgtttagagatttggaagatggtgtgtcatgcgatgtattgtgaaaaccccttcttcatatccctaaaagaccaccgctgatggtgattcatggtacaattgatgattgtatcatgatataattcagtgcttttgcagagggattggtgcctttttaaaataataatgatgctttggcttggctccatctgaattagtagagacagacatcttgagcaggttttatcagagttccattagctaaatattgggtttcctattttgtggcttgctttaaaccgctttgtgggcccttccgcactgaaagccactacagaaatcacctctttggtctgcagctccatgtccccaagctctgggctttcctgaatgagtggcctcattcagaagataatacagcatccctcatctgaaaatccaaaatctgaaatgcttcaaaatccaaaactgtttgagtgccgacatgatgttcgaaggccagattcaaaggaaatgctcattggagcattttggatttcagattttcgaattccaaaatctgaaaaaaatccaaaatctgaaatacttctgtaatttaacctgtaatagacattgggtcctgaccttccagctgaggcagcaagcagtcaacagaggctcaccatgcatccctcctgctcctcaccctcccactggcttgtgcctcaccccccagcctcccttgcacctgctgggaaggggacaggatgctcctgccctgccttcttggatctcaggctactgtgataattgcaggattccagccagggaaaatgctacaggtagaagtacttggtactctccatagagaagtttccagcaatggcacagcagccccgggaagtgtgctgccacacccagctaattttaaaaactttctgtagaggtgtgaattcactatgctgccaaggttggtcttgaattcctggcttcaagtaatcctcccacctttgcttgccaaagtgctgggattacggcatgaactagagctcccagccgagagtttagttttgtttgctagtggtgttcttggtatcttttcatatttgaggctttggtgctagtgctgaagtattacactcaccatccgaggttggcaggacttttgtttcagtattgaacagatggaactgtttagttcttcatctttgcaggtataccaaatgtgcctaccaggagtctgctttatagccattgaaaagcaagaagtaatatagtaaaattttgcctggctagaggctttggaagacaagtattttggcttaattctattaacttggaaggatgaaggtgaaaaaaaattcaaaactttaatttcctgtttattgccatttgaaaatatagccaatgattccacttttcttctccagtaagtttggacattctgatctacttggtgttttattatagaactcctagtgtgcctgagtcttacattgtgaagatccttctctaaaacttcacatgtaagagaatataaatgatattggataagatcaggctggatgagaactgatacctgtaaatatgcgatttagacgaaatctctgattgttttcttatttaactcataaaaataaaactcattggctggaaggtgggagcaggaaggagatttatgtcttttaattgcacgtcattgtttcatatagagacagaacatatagtatccctggttttggacctacagaatgaaacacatttttctacctgctgtatgccagaggttcttgaacacctggagggattactgcagcacagattgctgagccctactccagagtttctgattcatcaggtccagggtggggcctgagaatgtgtatttataagaagttcccaggtgctgctggagctgctagtccagagactacatttttgagaactgctctcatatactaactgtaaattgcagagctctagaaaaaaagcttagtttggtgtgggataagaagcacacaggttatggagaaaatcatgaaagattcaacccttgatcccagcctagtgtggatttcaggtaacaagcaatacacagtgacataacaaattcttggttttcatgactgcaagtgagagccaagtatcaagtgagaaattcagcttcatttgcaaggcttagagaggccaggtgattctagaaaaatgggccttgtatttctcttaaaccagtaaagagctttaagtggttattaaattgaaagctttgtgttcttacttattttgtattttattttatttcttttgagatggagtcttgctctgtcgcccaggctggagtgcagtggcgtgagcttggctcactgcaacctccatctcctgggttccagtgattctcctgcctcagcctcccaaatagctgggattacaggcacccgcaaccacgcctggctagtttttgtatttttagtagagacagggtttcttcatgttggccaggctggtctcgaactcctgacctcaggcaatccacccacctcggcctcccaaagtgatggcattacaggcgtgagccaccgcacccggcccaaaagctttgtgtttttaaagatattagacatgtttcttgtttttaaaagaaatcttaacaataatgtaggagaataagacaaacatttttccaaaaaagagaaattgttgtgattattttgtcttattggaatgtcggatactatagtcggcttcattaatcatcaagcatgctatggattttccatttttataggatctatatctcagttaaggtaatactggtaattcttgtactccatttgaagatgaaaaatataggccaaaatcacagactttgcacagaagctgcataatgaagacagctctggaggaacacatagatacacacacacagacacacatatatataaagtatatacacatatattttttaaagtttattttttacagttttaaaagttttaaagcaaaacccagcccttcccctctcccagagtgggcggcccctcccctttctctgagtgggcggggacagcggttgcatgggcagctttccttatgatgccacaggtccctctggacatgctgctgcctggccacgcctcctttccctttcatctttctcactgaccaatgggcttggagcattaaggccacgcccctattctgcgttccattggtgccctggttacgccacctgtggctcagttgcacagctgcctggtaggtgactggaggcattgagcagtgtgctcactggtatttcgctgatgtggccccaaccccgcctccctccccaccccgcgatgtcagaaaaaacacaacaggggaaattggccgcagccaagaaaaaggtaaaacacaccaggtcatggcccccaacccagccacagatcccctccgatgacaagaccggtgccagagtccataccactcctgaggcataccagatggggccccccaaccccagcccctctgggctcccccaaccaaagcctagtcagtcagccccaccccttcagcaagcagcccagtacctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactccggggctacctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccggcctttgatcttacaacccagtcccctaagttttctcaccccatttctggttcctctggttgcagcacaaatttccagctggaaggggagtggagactatgggacctaggagcaagaggtttcaggctgccttactccctcaacatagacattgacagtgggaaaaatcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgtgggacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtttacttttctacctctgcccctggttttggtccctggaagctgctgattcatggcaaaaccccagagcttggagtcagaggactgagtttaagttccagtattgccttttttgatctttcttttttttttttctatccatgatatcaatccctctcagtcactaagtgattgtgacaacaccttgtacagttgttggtggcattacatcagatggtatataagggtattttgtcaaaactgtaaaggaggatgtggctgtaggggctgatcattctcatgagtgttactgctcttctttcccacagttaaaagcatattggcagaggaagagccctggcattccagcaggagctaacaggaaaaagaaaatcaatggcagtagccctgacacagccacttctggtggttaccactcacctggggatgtgagtctcggcgggccagggtcctggcgacagggggcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaagggtccaagataggcagaaaagaagcttttgccagttgatgggggaagaaagaagtcagagggcttagacagtgaggggggacagaacatctccatgtgcactctcatctcttgcagtcagcaacaggtatctacggagaaggccgtgcatcctctactaccctggaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatcttcctccaactccttctctctgcatgcacctcagagccagtaccaagaactagcagtggccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgtcaggggtccatatttctgccctgcctcagtccctaatttgctttttgagtctggacaagccatctctcctctttatgctcgtgtttctggaggaggtagagagtatcaaaggtcttggttagctctgaaagtcagagatttaaaggcccctagaatggaaacctcagggccaagggctcctgtctgtcctttgctgttttatatctctgctatgaagaactgtacctggcctgtacatgctcagtaaatgtttgttgaatgaatgcacgtttctaaatcacaaactggcagaaggggggtgggcccttctcaaactctgtctctagaggttcaccagcccctccctccagggcccttttccccctttgctttgggcaggttcgcacatctaaggaggagaagaagcatgagatacatctggtacagaagcttgggaggagcttgttcaaactcaaaaaccagacgggtaagatggggctgccatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcagccacccacagtgctctctatctgaaagtgacttggaagactggctaccatccgggtgtgaggagtcattagcagtgaggccaagtttgggaagcctgagaggaggagctgtgcaccgaagggaggatttttttttttttttttttgagaatccagaggcccttattgtctgcttcctttctcagctgaacccctggccccagagcccccagcagggccatctaaggtagagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctacgtgaacaggaggagaggctacatgaacaggaggagaggctacgtgaacaggaggagaggctgtgtgaacaggaggagaggctacgtgaacatgaggagaggctgtgtgaacaggaggagaggctatgtgaacaggaggagaggctacgtgaacaggaggagaggctgtgtgaacaggaggagaggctgtgtgaacaggaggagaggctgtgtgaacaggaggagaggctacgtgaacaggaggagaggctgtgtgaacaggaggagaggctgtgtgaacatgaggagaggctgtgtgaacaggaggagaggctacgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggaagaggtggagaagctgttagaacaggagaggcggcaggaggagcaggagaggctgctggagagggagaggctgctggacgaggtggaggagctcctggacgaggtggaggagctcctggagcaggagaggcttcggtaacaggatgagaggctgtggcagcaggagactctgcgggagctggagaggctgcgggagctggagaggatgctggagctggggtgggaagccctgtacgagcagcgggccgagccacgcagcggcttcgaggagctggtgcgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcgacactaagttctggggtctccagttttagtgggtggccactgattgcttctctctgtccagaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcggggtgtggtggctcacgcctgcaatcccagcactttgggaggctgaggcaggacaatcacttgaggtcaggagtttgagaccaacatggccaacatggtgaaagctcatctctactaaaattaaaaaaaataataataattagccgggcctggtggtgcatgcctgtaatcccagctactcaggaggctgagacacgagaatcacttgtgcccgggaggtgaaggttgcagtgagctgagattgcaccactgcactgcagcctgggacacagagtgacactctctcaaaacaaaacaaaacagaaaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttacatgctgggaaaaaggacgtgagatttgatgctagggaaggaggcatggggttctaagcaagggagacagtctcttaggcctggagcaaggggccaggggcctgggcaggccacagagccccacagtgccctcgctaccctattaatgggccaggaatctggaagccagccaccacatgtcctcatgcccagggtcttccggcaggtggagctgaagagccaagaggctccgagtctgcagcagcagccagaccagtagctggagccccagtcccacaaggagcttggatgtgcggacaagcagggtggtgagtagagccctcaggcggggtgggcaggcaggagcaggggaggctcgcactgtgcccagattcccaccccctccctctctctgaagatcttagtgagctgagcctcactgatagcatggaggctgcaccgggacaggacagggagggttctcccccatgacaaccccactgcacagcagatccagcagctgcttcctctaatgcaggactccccaggagcacccaggcttgggtggagaagctgttggtacaggagaggcggcaggaggagcaggagaggctgcatgccattcttttcgggctgccgagaacagggagctaaacatcaccatcatctaagagcgggtcaaggaattaaaaaaaaacaacaaaacgtttaaggggttaatatcctacacaattcatttacttcatttgaatgttagagccacttatgtttatttgtgtttctaatttaaatttatttgtttctaatttatagtttaaatttatttgtaaaaagttaaatgagagtgggtctttctctcatgttcactctggcatcctttagcattttttaaatttgataattataggacgttagcatgcatatcgagtttgcccttatgtggtgggagttcaaacacacaaagacccactgtatgcacacaactgttcttgctggtttgggataggctgccatgctttttaaatgttagtacagcatgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagccttttcccctttttctgtgtattggggatgggagtaataacattttggggagctttttaaatctcccagaagaggaaagtggcctgctctggcaggtgtgtgcaggatagaatatgtttcatttgttctggtgccaagaatgagcgctgtactatggtagttcccttaggatttgcatgtgctctgggctcatgaagacattgcatcatgagctgtggcagttgtacttttttttgatgacctaaaaggggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcattctccttaatgtattcagtaaagatcagaagaaatcctttaagagtttaaatgtccctgaaacaggcatatacaggctctagtcaagaatgaattcgagtgaaggaaagctgtgttacacctggcattcctctgtgttcatggagcttatttgaggctagaagatggattttaccatctagacctctctggctaatagctagtcttcaaccatctgacagaggaattctttttcttgaatggaaaaggctttaaaaataataacaaacattattataaacaaatatatgtgagagtacttagttgaaacaaaaaggaattttagtagacagtattatactacatttgaaaatcaaggagcagtttatgcaacttaaaatgtttacaaactgcagcgcaatctactgtttgtgaatgtcaaagtgtcatgaggaaagtgtctatacaatcacggagttatatttcctcacaaagttctttacgaagagtgaaatatgtttttataccttttggtttcagttagaggcatattttgtgtaatatttatgttaatgtgcatgatcaatgaattatttcagtcatatgttgcctatatcataactggaggatgcttggggaacaatcaacagctaaaacttcatgaagttctaatgtctgtgttccaaaatacatcatatcattaggatgtagggagagatgtatctgcactccctggggtgggcatttctagttactagaccatctccacttttagcattgggcatcctcatgatacttttataaatatgacattaataggagatcaataatacgattttacagattgaataagagaattgcctgcattcacttaaagattgcaaatattgagcccttgtgacttcaactgactcttccaaattgtatgaatttatcaatgtattagagaaactcagtttcagaatgataaagaaaaactggtagaccaagcaatgtggctaattaacagtggtaggatttccagcccaagggtttaaaatggacttaaggtcctgttcttgccttttattttctgaacttgctgcttttgcattctttgagttcagtttaaagacagttcctttaagtccattttaaaccctcaggctagaagtcataccactgttaattagccacattatttgatctaacagtttttctttatcattctgaaactgggtttaccgaatacattgataaattatttcaaaggtatttttatagttcaaatcacttcacttttaccctgacacgtataaatgactaggaatgaccttcggatagcgtttagcatctgtaaccaatctgacaataatgtgttcatcaggtacctatggattaaatcacatacaggcatatttaagctgaacgtcagtctgaaaaataaatgtactatattaactgaaataccactcttcatgtaggtattttgtcatatgtttaagaaaaagctaaaaagaatggaaatcatgtgacaataacttaagtcttccttcaaagtgcatgcagtcttttgcagtacctcattcagccaagtatttgttctcttcctcattcagtataaggcagctttcaatttgcttagaaggcaacattagaaggttagagttcatcagaaacagaattttaaaatatgagttcaactgaataaatgtgaatttctgtaggaagtaaagaatcaaaatacctatctaaagatggcaatatataataattatttttaaagtatttgattaaaccagataggttttctcgaaatgaaaaaaatcagttctaaaaccaaagatgattttttgaaaatgtgaaaatgtaaatcagccctatccataatataatttctctaaaactgtatctgtcattttaaaataatataactattaaaaaatgtaactgctatcttattgttttgaaataagttaaaacattttaaatatgaatactgcagtttaaaagaaagaaaccaggggaaggaaaagtagagaaagaaatgccaattccagtccaaagctttatttgccaagttttcttagaatgacttttacctatttatgaattcttacaaacagaatgtataatggaaatactgacttttgcctaaagtggcattgttgactgctgtgatgttactgtaatgtaataaattattaaattgttgcaaagtgctgtttttgccttaaaatttcgtgtgtcttgaaaactacagtattaaatactatagcatgcaaataatgggcatgcttggcatgagataatctgtttttattgttacaaaattgtaactatgtaagtgtgtttattaaaagaacaaacaaagttatgggatgaaagagttacgggataaaaaatgtggaaaagtgtgtcaaaaaaagtagaaaaaattgtatgaaaagttatttaaaaagttatggaaaagaagttatgggattaaaaaaagtcacgggatataaataaaaataaataaaagcaggccccttccagcataagcctggagaagtgggtctggactctccgcccccaccatgtccctaccaccccttcccagtcagccctttaccattagggtagcaagacccctgtctaatggggggagacagaccctttgccaccttgaccagggctgagtccttaaatttctggacgatgatgcttgttatttaagagccagaggctggtggagttggtttgtttggagtaggcctgatggcctctctactcttgccaaagcaacttttccctcaggggagctcccatcttcttattcagagaggcagctgaggcaggacagtggggctaacagtagaccaggcaagggcatgggctgctggggtgacccccccttccccagtgtatatattgtatctgcgtaacattttgtatattctggggagtggggctgcccctgtatcgtacctagtggaggttggagctggcatatagggaggaggatctaataattatttgcatctgggaaacgtatttattgctagcataggacataggaaggaggcggggatggggtcgtggctcccttggtgatgcgactcctgtttattttgcttttcattttggaataaatggatttagccatactgctcagcctggtgtgttcccgtttccttcactgggtcctggagtttgtcccactgaatgaggagccccagagtgtctgagcatgtccagctgggctgttggggaccttccaggcctgttacctgtatgctgcctggtgacacctggtggatttcatggggactgccatagcacctatggagcacagtacggccctgacagccaacaggctcagaagcctgatctagcagtggccgggaagtcagataccagcacccaagggcactgacttccatccaccccaggcatcttcccttccgtccccttgcctccttctcctgtctgcactgggtggcctgttctgtctgtccctccagaatgccggctgcccctcagtctccctccaggctgagatcatgaccctgacccctagtggccggagctggcttcacaggataaaagccagctaagctccagggactttccaggaaaagtgtcccttggaaaggatgtggtcttttcacttgctcccaacagcacctaaacatggcttggcctttcccctcccctgagctccacagagaacacagccagcagaggacacattctccgtcatccggaaatgggtttgattctcagccgagggacagcaggactggtagagactgtcaggccacatggctgcctgcacagcacccccatgcttggtggagggtgggagggatggcgggggctggctgtccacaggctgggcatgacagggagtctcactggaggtggcacactttggaggggcgatgtcaggggacagctttctcttgctggaccacaagactccaaaaggacagcacagggacttattcttagtgctagaggcgaggcggtcggccatgtgtaactgcatatatatatatagctatttatagaacagggcaggggcataccacagagggggcacaagttttcagcaacggtcacacctggatgtgtcagctcaccactacaacagactaagtcacagatgaagagggctggctttggggctggagagccactgtcaagtcatagtacacctgctcaggcaggcttggaaagggaagtctccaagtagaggagggatctgtttagaggtcaaagtggggcctggggctctcaggacgggatggacttgcctgacccgatcagctggcaagtggagagaaagcagagagaaaacaggagagagaaaagcaagcggattgctggtgaggcaagtgcagagcatgggagtgacacagcagctgtgggagggctggggacgggagggcacaggtgcgggtgtgtagtaaggttcctggaaaaggggctggaagggaaaggggaggaggatggagggggaagccggagcttcacaggtagtgcctgggggctgcagcggccctccccaccccacacacgcctctcccatggcatccaggcagtgcacccacagttcagaccaatgctcagccccgtcaggcttcccttttctctggtcaccctgtcttccaacccactggcccagggccacccctcgccttggggagccccaagcaacagccaccaggcctgatagggaaggaacactgcttgaaccaggatgatgaagctaaaagggatggatggttggagtgagcactggaggcccctttgggccatcagaaagcccagaaccctctgagaggaccctgggggaggcagggagggcaggcagccagatgccactggccatagacttataagtctaagaggggagcctcagcttgttgggggactgcaggtcacataggtgaggctgggcccttcctgcagggaaaagcagaagagggagagtctgtggcaggagaggcgggcaggctcactggacagagctcagctgggccagcaggcactgtggtccccttggttgaatagcataggtgacctctaggagcaacaggccaaggtgcatgagccaactggctggcagtagtgcttcagcgggggccagggaccctgccttcggtcacacactagcagctgtgatggtatctgggagggagagatggggtctgtgtgtccctgcctggcctgtgaagtgtgttgtgggatgaccgtgtgtataggactctcaggcttttatcctagatcaccactggattgctgacagatagaggaagtgggaccctgactatcacccctaatctggagtggatttggctctcggcactcccaggctgggagctggatacctgccctgcagcatgactcagactgcacgacaggtacggcgtgcccaggatgatgttcccaggcctctggctgcctcagaatccagcccaacacacacccccctccaagctcccagcccccacaccataaaccacaagctctctgccctctctgatggctccagagagcacccacatctgccagcttgggcatggagcccgttccaagactccccaggctcagtcatggaggctgggggactttgggaccgtgggggccggccctggtacctgcgtccagccaggatgctctgcacctgcagccaagagtcatccacgggcccccatgggcatgctgatggtgatcatgttgatgtcgctgatgctgctgagcacctctgtcagcatatggtgcatgcacagcatctcatcgccccgctgtacctgctctgcagactcctccatcagcgtgttctggtccccatgcgagtacaggttggatagcagctccaagaagatgaattccttggtctgagagtgggcaaagaggcaaggagggtgcaacctgatgcctgtgctgccctggctgccctgccgggccctgctaggactgtgcgctgggcttggagccccaagtacggcttttcaggcgcagcttctacaccacttaagactcgaagatctgcctccccaccgccttttctcactcagatggggacactgaggtccagaggaaaagtcacctgtccaaggttacagatctggaaggggacccaggacctatcatgccaccaggacacctgtctacttggtttttaaaaattttttggagataggatctcactctgtcgccaggctggagtacagtgggtgagatcactgcttattgcagcctcaacctcctgggctcaaagtgatcctccaacatcagcctgttgagtagctaggactacaggcatgtgccaccaccaagtccagcatttttaaaatttttatgtacagaccaggtctcactatgttgcccaggctggtctcaaactcctgtgctcaagcgatcctcctgccttggcctcccaaagtgctgggattacagggatgggccactgtgcccagtcccatgttatatttctatgggacagctctggtcttgaccatgcctccctccctggacctggtcccatagggctggtcggcatctctcccaggccagcatggccacctccatccccagtgccacagtcgccccctgcccccatggggcagtgcatgaacattgttgatcatgaggtgcatgatggtcctgggcaggagaccaaccatgaggtcccacactgtcttgttgacaatggccgtataggagtctaccaggttctgggtggtctcctttaagatctatttgcttagaatagtgtttactagaggtgaggaagggggaggaggtagccaaaggttggctaacagattaacagatataagagtacatggctgaatgtggtggctcacacactagcgtaatcctagctctctgggaggctgagcggggaggatcacttgaggccaggagtgcacggccagcctgggtaacacaggaggtattatgtctacaaaaaatttaaaaattagctaggcatggtggtccatacctgtggtcccggctactaaaacccaaattgaaagacaaaataaatcaaccatgacttttcacattttgtgaatgtgaccaaaatgtgaccaaggactgactgaattacatagtattacatcagttacatttcctgattttgatcattgtattgtggttatataaaataatgttcttgttctggaagtaacactgaaatatttgggagtaaatgggcacatctccaacttaacttcaagtggagcagaaaaaaagttgtgtgtgtccatggaatactatgcagccataaaaaaggatgagttcatgtcctttgtatggacatggatgaagctagaaaccatcattctgagcaaactgtcacaaggacagaaaaccaaacaccgcatgttctcactcataggtgggaactgaacaatgagaacacttgggacacaggatggggaacatcgcacaccggggcctgtcatggggttgcaggagggatagcattaggagatagacctaatataaatgataagttaacaggtggagcacaccaacatggcacatgtatacatatgtaacaaacctgcacgttgtgcacatgtaccctagaacttaaagtataacaataattaaaaaaaaataaatcgttaaaataaagaataaatgtaatagactttcttgaatataaaaagttgtgtgtgtgtgtatatatatatatatatatataaagaatatatggcctggtgcagtggctcacacctataatcccagcactttgggaggctgatgcaggtggatcacctgaggtcgggagttcaagaccagcctgaccaacatggagaaaccctctctactaataatacaaaattagccaggcgtggtggtgcatgcctgtaatcccagctacttgggaggctgagacaggagaatcacctgaacctggaaggtggaggttgcagtgagccaagatcctgccattgcactccagcctgggccacaagagcgaaactctgtctcaaaaaagaaaaaaaaaattagctttgtgtggcggtgagcgtctgtaatcccagctactcaggaggctgaggcaggacaatcacttgaacttgggagatggaggttgcagtgagccaagattgtgccactgcactccagcctgggtgacagagtgagacttcatctccccccccgcaaaaaaataaagccattgaggcaaaatgtgaactggtaaacctgggtgttctttgtactattcttgcaacttctctgtaagtttgaaattatacaaaaattaagttacaaaacacattaaaaatgtctgctgtatttatctgcttgacagaaatagatatgtaagaatcactttaaggctagagctttcccacttgctggctgctttttttttggagacagggtcacacttcgtcgcctagattgtagtgcagtggcatgatctcggctcatcgcaacctccacctccaaggcttaggcagccctctgaccgcctaagcatgtgtagctggactacacatgcacatcaccatgcccagcttattttctacctttttagtagagaggaggtcttggtattgcccaggctggtctccaaccctcaggctcaagcaatccctcccacctcagtctcctgaagtactgggattacaggtgtgagccaccatgcctgcctgttctcctggacatgcagccagctaagcttggctctgcaacagctccttgtcccactggagaaaaagagcccacagctttcctcatatgcaagggcatgaaccaaccaagtgcagcccagctcctgtgagacacacacacacgtggttaactgacagcgacagagagcctaaataaagctcagagtccagggtagtctacccaggttgcagctggtgagctctgcctccggttaggctgaagcatcccagtatcaatcctcccatacacatttattcacatttgttgagatctcctatgttctaggcattgggctcaacattggacacaaagacaccattcatcctaactcccactgaaagaaagtcaacctctgatacacgataatcctgttgctaccttctgaacatgggcaagttggcccaaattgtatgtacccagcaggggctgaagacccagggaagcagggtggagctgccaaagcagctttccaggctcatactgcagaccactctcaacacgttcaggcttgcccttgctcctttactaaactctggtgaacccactccccataaaccagatgcagcagcacctgaatcccagacaagtgccagctgatctgttgcctcgagagctcctgcctttcctctacccacacacaactgcaaagatgacacaggcaaggctgttgtcccagatttattgaaaataatacagcactacagaaaaaattcaaacaggtccccgaggcgttttgaaattcatcccaactgtaggctgagtgacctgaaggttggacagactgccgaagtcctggaacgagaaaatggattcagtgagcagttactggtgagatctgtgagtggaccccagaagaaaacacaggcccctagagccacagcactctcaagggggtccagaggcgacctgaaggaccctttaagagccaacagggttctcaatgcctcccacttttccagagtgatcttccttcaacacacacctgaccatgtggtatccccatttacaactctatgacttttacccaatgtaccatgccatttgtatctgttttcacaaccccttcctatcaatcactctaaaacaccgtttctcaatcttggcaacgtagacatcctgggctggacattctttgttataggcagctgtactgtgtattgcagaaagtttagcaacatccttggcctctaccccttagaagttagcaggtatcccctggctatgagaacgaaaaatgtgtctggacattgccaaatgtcctctaaagcaaaactctgtccctttgagaatacacagtgccacttgctttccaggaccagccctgggtaagagctattactaatctaatcaacatttgtgaagggcccaagtacacaaggcatcaagcagaagggagggaggcaagagcagaccctgccctcaaacaagttcaggctggtaggcagggcaagaagccaagggcccaacttatacctggaactccatgtcctatttggtcctcagaaacccattttagtttcaacaaaaatgctgcattcagcgcagtggttatttcaggaagaaaagacccacagcggggctgtagctgtactggtgatgtttttctgaagctgggaaagtacatgtgagttcattttgctactacctttttgagtgtcttaaacatttaatgaccataaaaataggaaaaatgaagttgttcaaaatcaccaaccgcccatgaagcccatgctttcacccaagtatgcaaaaggactaagataagccatagaaaaaacatcaaagtgcaatgaagatactcgtgaactacctaagtagtgccttgtatgtacctggaaatggaccaaagctcatttctgagtggttagcatggagacaccaaaggaatgccttcacagaagaaaagcaggcagattcagccagggctgacacaaagggggcaacgtaagccagctataaaaccaagaacagaagcagccaagagagaaaaggtgtcctggaagccactagatttgggaatcatgatcttgtggcgaactaactcaatgcacacaacttccgctacaccccttatgaaagcagtccagtttagtggctacaagtttagatgggattcccaactctgccacttactagctgggtgaccttggataataagacctactgatggtttttgaccaggaaaataccactttaggaatccagcaaacacttaccaaaagcttcagcatttccttagtgtcaggatctacttcaataatctcctgatccaaggctgagacctacaaggaaacgaggtagggtcaaaataccaatcaatgagattatcactcacctctcctcctcctctccccaggttcttaaatatggggaagaggagctgcacaaggatagcattcctctcacaaggtgagcagtctcttacagtattacagaccccgatgacctgttcttctggccttaccttcccatgccctcattcagtattcagaacacttgaagtctgtgtttacaccaaagaatactatattaggggcaaacaatcgagccacgacagcagtcatcaaatcaacattaagggctctcatgaaatatggaatagacttaactggttccagaagagcagaatggaggctaagaaactggtagggggcctatgggcacccacagctggttatggaatgtatggattaaaggtctcagattcagctgaggtccctttggaagccaagaacccatagctttatcatttgaggattagccagaagcccaaatatccagaaagtttacctcaggaacataattgtctctcctttctctctcctcctcctgcagcttgatggagatacctcttactgggcctctctgaattcgcttcatcagatgcgtgacataactacaaagcacacacagccaaagagaacagtgagaagacaaatcaactcccacctggtactgagcacatgtgcatatataaatacccgctttagttcttttccacagtgagaaggaagaggactcactatcctgggacctcctacacatagaacctccactggcctgagcattccttccccttggtttctcactctctattcaaactctccttcatgatgatcaagcgccccacccccaactcgccccgccccgccccgcagtttcacgacccttcacagccttcattttcttccaatttcaaattcacataacttggcaattaatacgttgactttggcactattcttccaggccatatgcctataaatctctcgaacagtaactgcaactgtgaagtaagcattagaagttgacatccagccgggcgaggtggctcacgcctgtaatcccagcaatttgggaggccgaggcgggcggatcgcttgaggtcaggtgttcgagaccagcctggtcaacattgtgaaaccctgttgtctactaaaaatacaaaaattagccgagtgtggtagcacgtgcctctaatcccagctactgggaaggctgaggcatgacaatcgcttgaacccgggagacggaggttgcagtgagccgagatggcgccactgcactctagcctgggcgccagggcaagattccgtctcaaaaaaaaaagaaaaaaaagaaagaaaaaagttgacaactaaaagcaacgtagcttcaaagcaagaggtctgacggtggctaccttcgacccagggtcaccgcggccagtcatgacacaggcctaagttcacaacagaaatcctgcacacgcagagctctagcccttctccgggacaccagggagtctcaggctaacgaaaccaccaaggcaccgtctcttcccgagtcggagggcggcagagcacacaaacagatcgcggagccccggaggccgaggaaggcccgactcaccctgctatcttgttgcggagctttttgctggggataatggcgatctcctcgcacacgcgcttgttcgtgtggaagtcgttgcccaggcgcgtgtagtacttttctatgatgacccgggccgccttcttcacggttttggtgcgaacgcggccctgcgggtggagaggacaggatcactcacgagccagcgcaaccttctgggaagagtgcggcgccgagccccggccggtgtggttggggaccgccggctgcgctgagccggagagggcccggctaaacagtgccgggcgccgggcttaatgcggaagccgccggcccgttgcgctccagcctgacagggctctgcgccttcccggcccagggcctctctgtgggctgaggaccgcgggaagctgcagatgggggacgattgtggaggatggcggcctcgagccaaaacacctaccatgttggcgggtccttggtaaaagaggaaacaggaagcacaggcgaagcctgttaaagcttaggccagaaagccgcttccgcccggccacggtcgctctgagcctactcgggagccacacagcgccccctggcggagtggagcgggggcggcggtggcgcgcccctccggtgggcagggtgtctgtcccgcccccgacggctcctccctttccgctccccgctcccctcggttgacttgggctcgcttctctcccccatctgatttttaatgggaccgcccgtgcgatgtgctctagcgtagcgtccatctcttccacacacgccagggagaggagaagcatccggtcctcgggaggaccgagaaaagaaggcgatccagggccgtggaacaatgaggaagtgggggatggcggccgcccaggtcccccactcagtccgcgggccggagacttgtcaggtagagacagggtgcgactgggcgagacgtatctcatttcttccgggcctttgctcaaatgtcgccttatcagagggctttcccttcaaacttaggtaaaataactccctcactatccctgcttatatttcctagcacttgccgtgtgattcggcttatttttctcaactaggggtgagctccatgacagtaatggtcattttgtttagctaattcccagtgcttgaacagcgcctagcacgtaacaacctctaacattgacgtgaagggcccagctcaccagcagagctcccaacacctcaggtaccttctccatccactatcttcaggctgttcctgccgcacccatcctcaaaccagggccttccgaagccaccagcgcaggctgccccgatgggccgcagcctaggtagggccctgcccccttcttccaactctgctccctgggctgacagcaatcctaggctcccacctgacaggggaaggctgagctggccaggctggatgagttaagcccagggctgtgcctcattcctcaacgcaccttgggtactccagtcggactctcaactgattggggatggaaacctgaaggacaggaaaccctggcagcaaaaagtaccaatgggacaaaagaaaaggccagaatctcagaactgcgggagcaaacttccagtcaagctgctgtcaggcccgaagtgaaagatcagggtttttgtttttgtttttgtttttgagacggagtcttgctgtcgcccaggctggagtgcagtggcgcgatctcggctcactgcaacctctgcctcccaagttcaagcgattctcctgcctcagcctcccaagtagctgggattacaggcgtgcgccaccacgccctgctaatttttatatatatttttttttagtagagatggggttttgccattttggccaggctggtctccaacttctgacctcaggtgatccacccgccttgtcctcccaaagtgctgggattacaggagtgagccattgcacccggccagccttttttttttgagatagagtcttgctcagttgtccaggcttcagtgaagtgacatggtaacagctcactgcagcctcgatttcctgggctcacatgatcctgctgcctcagtctccctagtagctggaaccacaggcacacaccaccatgcctttttttttttttggtagaaatggggtctcccatgttgctcaggctggtctcaaacccctggggctcaagcaatcctcttgcctcagcctcccacagtgctgattgtaagcgtgagccactgtgcccagtctggcctctcctttatttatttatttatttagagacagtctcactctgttgcccaggctggagtgcagtggcatggtcttggctcaccgcaacctccacctcccgggttcaagagattctcctgcctgagcctcttgggtagctgggattagaggtgcctgcaactaccacctggctaattttttgtattttcagtagagaaggggtttcactatgttggccaggctggtctcaaaatcctgacctcgtgatccgcccaccttggcctcccaatgtgctgggattacaggcgtgagccaccgcgcccggccaggcctctccttttgtgaggagactcccccaccttgcccaatagttcttgcacctctctcagaagagacagcttcagtatgcagggttccctccacctcagactaaattggaggttcccaaagaatcggtccaacagctgggcccaggccaactcgactgaaaaaaaaaaaaaaaaatcagcagaccttgccagaaatcctgtgagctctgagaaagttccgttgatagggctctctgaacagcaaaaacccaatcgctccctctcagaaaggaactgcatcatcataggtgggtccaagaggatgagcagcctccgaagaagtaataggccaagacttccaggagaagctgagaacaagtggcttctgctggcacgtgagcagctgtgcctccagcattctctaagctgggcctggaggctgtgaggacccccgagaagctaagatatgaggactttttatatttgggctagaagcacccatccactggagaagcatctccaaagtatatttgacgatggaagggaccaagaagtactcacagggcaggtctcccacatggtcccaccattatcctgggccaggatctccatcacagaaatccaaggaaacaagctgtggctgtgccattacccccttactccctcccgttagccccttgctcccagacctcaaacacagagacaaaaccagaactctgctgcaacgtgtttattatgtgccaaaaaaactacaccacagcttactccacacatctgtaggagagtgcagtcttgcctgcatatactacaatgaggtagagacttcacacacagcttcacaaaacccacagagtagctgggatatgcaacaatgcaacgtcagctcagcaggagggaggggttatgacactggttctttggcacacagcttccctaggaggggcaagtagtttttgtgggttttttgtttcttttttaaaaaaaaaaaaaaaaaaaaaaggaaagaaaaaaaagtcaagttttcaaattccagtggcatttcagtcaactgcaactgttatctcatacattcctcaaattaaagatataagggaagggtacttgccccctctaagagaaagggctcctgtgagccttcatctgcccccaccgaaaagcagccctttttagctcagttacaaaagaaaaaagtcctgtgactttgtgattaaaaacttctatcaaccccacccccccacataagtgcaacttaaggaggtgcaataaaccatttaaaactatatacagcagccgctcaaacaccgtttatccggtccagtttcaaataaaacaaaaaattttttttttcttggttgcaaatgccttgatttgcaactgtgagaaacagtgaccagcagtcccccagacacaaatttgctataatgttaaaagctgccaggaaagaaaaaatatcttgttccaaacgacttaaaaactgttttaaggagtgtaaaaaggaaccggtaaaaaccctcgagcgtaaaatatgaaatatgattttggtttaaatgaagagcaaagtctccttattgtttacagtaaaaaacaccagctgaacactcagtttatgccgttcaggtgggggttaaataaatggaaaggcactgtatggcaactgcaagaatgaaaccaatgagacctgcgcatcatcaccatcagtattgcaaggaatgtaaaaaagcgcttttaataaataaacctaggtgtaggcatccgtgtcaatacctcaataccttctggacacgtagttttttttttttttttttttttccccgcttttcatctgcaaaatgaggaactaaaatctgggaaaactacagagtcgcttggagggtaagccagagggtccttgcccttggtacaccccctgaaaacaaaacctgacaaaactcaatgtgcattaattagtgcagaaacaaagacagattcagcaagtgcaaaggtgactacaattttcccttgtccttgggaagccagctccctggtcgccagtggcagggtggtgcaggctgcttgcctgacctgccagctttgggcgccacaggccactgggcaaggccagctcctctagctggaatctcggttcttctggttccgcatcagggggctgtggtggcgcaggccctccatgctgtgccgccagtgccagcagctccggcagaagtatttgaagcagacctgggttgggggaacaaaaaggaggatgccatgcctgtgtcagcaccagacacaggagctgttgcacgagctgcttgttctgtttggagaagggtgggagactcccgatggcctctgtgggttagaagaaatggtccctaggaatgctctcaccccaacacagaagcctgattaactatggcaaacccaccatccttgttacaggtccccttacttaaacatgttgggctcgtagtgtgtgcagagaccatgctagtttctcttatcccctctaaccatgacagctgctctcctattcccctgcccttctcacctcctacagagtagttgtatcacatggctgctaacgtggagaatgtataaggatactgactaaaaattctaatgctaggcaacatcctgctttcttcccattaagtgaggagaggtgactgggtttctcagtctagtcccatctcttggttgctgtgtaacgtcaggcaagccactaatctctgagcaattatctgactatggagattatctgtgaaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccagaagcagaagagaaagaaacaggagaaatatttgaaacaataatgactgagaatttctctcaatgtgagacaccaaaccacagatccaggaagctcagaaaacatcaagcaggataaatgcccacagaaaaactgcatctagccacctaagttacaaactatgaaaaaaaaaaaatcaaaagatgaagagaaaattctggaggaacctagagggaaaagaaaacacaccttacctacagagaagtcaagataagaattacatccaacttctcagaaattgtataagcaagagactggagtgaaatatttaaagtgttgagagagggggaaaaaaaccccaccaccaacctagaattctatattctgtgaaattactcttcataagtgaaggagaaataaacactttctcatacaaaaattgagggaattagttgccagtaaacatgccttgaaagaaatgttaaagaaaagttccttgggaaaaaggaaaatgatacatgtcagtaacttggatgtatatcaagaaaggaagagcactggaataagttaatataaaatgaaaattttattcttcttattcttaatttatctaatagatcaattcagatcaaactgatcaatagatcaaacatcatttgttcaaaataataattagcaataatatatttgattatgtatatattttttgtatataaatgatgtgtatgtttgtatataagtgaaatgaatgataatgatacaagggacaggagggaagaattaggacaattttgttattataagatactcacactacctgtgaagcagtagagtgttatttaaaagtgcacttaaactagttgtaaacgtattgcaaatcctagggaaaacagtacaaaaagaagtataactgatggatatgctaagaagggaaagaaaatggaatcatgaaatgctcaattaaagccacaaaagatggaaacagagtggaagtcaaaaatagaaacaaaaacaaggacaacaaatagaacacagtaacaaatatggtagatattaatcttactatattgatataataatcactttgaatgtcaatggtcaatcaccaattaaaagagagaaattgtcagagtggatcaaaaacaaaacccaactatacactatatgttgcctacaataaactcactttaaatataaagatacatatagattaaaagtaaataaatagaggaaaaacataccatgctaacactaatcaaaagaaagcaggaatagctatatgaatttcagacagagcagcttcaaagcaaggaaatttagcaaggataaagaagggcattacagaatgacaatgggaatccattctccaagaagacataacaatcattaatgtgtatgtgctaacaacagagaatcaaacaccctgaggtaaaaactgatagaagtgtaggaaacatagatggatccactatcatagcaggagacttcaacacgtctctatcagaaatggacagattcagcaggcagaacatcaacaaggacttaacaaggccattaattaactggatataattgatgtctatagacaacttcatcccacaatagcagattacaattcttctcaagcttacatggaacattcatcaagatagaccacattctgggccataaaacacactttaacacatttaaaatcatagaaatcatacaatgtctgcttttatgccacagtggaattaaattataaatcaataacagaaaggtaacaggaaaatcccaaaatatgtggaaattaaacaactttctttctttctttccttccttccttcatcccttctttccttccttccccttacccttccttccttccttccttcttccatccttccttctctctctctctttctctctctctttctttctctctctttcttgtgggatacagtaaaaacagtgctatggggaaatgtaaggcattgaatacatatattagaaaagaagacagatcttaaatcaggattctaagtttacacctgaagaaaatagaaaagaagggcaaattaaatccaaagtaggtcaggtgctgtggctcacacttgtaatcccagcactttgggaggccgaggtaggtggatcacgtgaggtcaggagttcaagagaagcctggccaacatggggaaacccagtctctactaaaaatacaaaaattagttgggcgtggtggctcgcacctgtaatcccagctacttgggaggctgaggcagaattgcttgaacccagcagccagaggttgcagtgagccaagatcgcgccattgcattccagcctgggtgacaagaatgaaactctctctcaaaacaaaaacaaaaacaaacaaacaaacaaaaacaaaaacaagtcttggagttgtagcttccgtgaactgtgatccttgagaaagttaggaaatcccccactgggagtgaacctaggaagtagttcttccctatctctgttattttcatctccttgacctgggctcccctccttatgttttctggcctggattctcagatgaggaaactgaaactcacaaatatgcagtgactcagattatacaactattaaacggcccacttgggcctgccctgggtcttgttactttcaaagcccacgctcttgacagtgcattattttgtccatccattgtctcccattttacaaaacacatgcctgggccaagattaaacttcttgttgcccattcttacttttggcttttccccacttctctgagggtttaccacacagtgcccctaccaccaagaggccctccttgtcttcactgttgaattaacatatgttaagggacatctcaaatgcatcctccttgatgaaacttttcttcattccaacgcattcataaggtgccatcccttccccttgcttggaccttgtcagcactgtgccagagtgggggtcttgggtctaccacacccatttttctgctttgttttctgtttttttgtgggggtcagagtctcgctctgtcatccaggctggagtacagtggcacagtctctgctcactgcaacctccacctcctaggctcaagtgatcctcccacttcagcctccagagtagctgaaactacaggcatacaccaccacgcctggctaatttttgtattttttgtagagatgggatttcaccgtgttgcccaggctggtctggaactcctgagctcaagcaatctgccctcctcggtcttccaaagtgctgcgattacaggtgtgagccactgcgtccggccatttctccatttgaaggcaaggatggtgtcttatccactgtcctggactttggagcacctagtgccccctcacagttagtagccaagggtcacataccaaatgccatggactaggcaggtaacataaatgagcaaacgaggtgggtagggagacagatttttcctgaaacatggggcttcttggcccatctcttgttttcccacttttgttagagactcagttctttactgagtgaaaggaaacacaagcatgatgggaaagggagcctacttgcagccacagtgctgggaatgaatagggagtggtggggactgaggaccggggagcataggcccttcctaaagggaactcactgctccaccccagccacttctgccagggagcaatttaagcctgacatggatggatgataagacttttcaagaaaagctgaaaattgagatttttgtacaagatcatgtgattcctaaacattggcaattgactaaaacatttttcaatatttgtgtcagccaaaacaaaccaaaaaatcaataactgatcaacacaagcaaatctgcacgctgtggttgaggagttgtagtcccatatgtccttattaggatgtcagagcaagaagtcaccttaaatcatccagtccggtggtttctgaatgccagcctctgaactggctagatcagaatccctgggaaggtctagaaaaacacagaaaatacacattctagggcccccagagccctggatctgtggaactagaatctctgggctgggtcctgggcatctgcagtttttcagagctctccacgtactgctgatgaccagccaggttcactcccagtgggggatttcctaactttcctgaggatcacagctcccggaggttcttggtaaaaacagcttcctagtccctagtcctagtttcctggaaatgctggtatagtgagtctgggatggggcctgggaatttgtttttaagaaactcatctgtgagatctggaaaatccttgcactagtggcccgttgaggctcagtgatgaggaagacttgctcagagccacatagcacgttgccccagcccatccaacctcctgactctcagagaaagctctttgaggccggcactgctggggcagttgtgagcagtgggagatgctctcagcaggggcacagcactgacgtgtgcagggcactctacatgcagtttggcaggggacagactggagggcgggtttggtttccgcagcctgctgggatggagctttgggctgggcagcagcagaaggaatcctggtgggatgtcagcagggcactcaggcattcatgtgagcccgtggagtctattgtcgtgaacagccaggatcctgggagctgggtataaacccaatcgagaaactccagattgccaagttccctaactgtgctctttagagcctgggaactgcagagagggaaaagagtgggaaaagcatggatgccagggctcccccacccccggcacatgagatttcttttgagactagacctggtggccaaagagatttgagaaacgtgatctaattcaactctttcacattaacgatggggaaactgaggcccagtaagggatggactgttgagaatataaagcaatgttactgaagagactgaaaccatttgggggacttgagtcccagtctcagcactgccactctcactgtcactgtgtggctctaggccaatctctccacctctctgagcctccctttgctctctcacctaggaagcagtctggacaccctactgcaggtgtcctaacctggggtccacagcctaagggaccgtgaactgaggggatccatgagcttgaatgggaaaatattacatatttactttttgtaacctctcaatgaaatttagtatttccctcaattatgaatattattagcaaatcccaacagcacctgtgattttgttaccaatagaacaaaccaaatatttttctatctcattacagttgttgcatgtatcttgaaataaggtttacgttcatcactacttcaaaatttccgtagttgctgggcatagtggctcacgcctataatcccagcacttttggaggctgaggtgagtggatcacttgaggccaggagttcaagaccagcctttccaacatggcaaaaccccatctctactaaaaatacaaaaacttgctgggtgtggtggtacgtgcctgtaatcccagctactcgcgaggctaagggacaagaattgcttgaacctgggaggcaggggttgcggtgagccaagattgagctactgtactccagcctgggtgacagagagagactctgtctcaaaaaaaaaaaaaaaaaaaaccatagttgtttaatttgccagaaaatcttgtttaaagtataattccacaccctactttttaaattattttttgttttgttatgttttgtttttgagataatgtctcactctatcacctaggctggagtgcagtggcatcatcatggctcactgcagcctcgacctcctgggctcaagagagcctcccatctcaacattccaagtagttgggactacaggtgtgcaccatcatgcctggctaattttgtatgtgtgtgtgtgtgtgtgtgtgtgtgtctgtgtagcgacaaggtcccattatgttgcccagttggtcttgaactcctaggctcaagtgatcctccccccttgttctcccaaagttctgggattacaagtatgaacaaccttgcctggtcttaaattattttgataactgtatttcaatataatcaatttccttggtactcctgtgcatttattttatttattttatttattttttatggcagggtctccctctgtcacccaggctggagtgcagtgatgcgatctcggctcactacaacctccacctcccaggttcaagcgattctcctgcctcggtctcctgagtagctgggattacaggcatgtgccaccacgcctggctaatttttgtgtttttagtagagacagggtttcaccatgttggccaagctggtctcaaactcctgacctcaagtgatttgcctgcctcggcctcccaaagtgctaagattacaggcgtgagccaccgggcccaaccactcctatgtattttattttctgcatttcaaaatattgttctgagaaggagtttgtggcaaaaaaggataagaatccaggccttattgggaaatcctagaggacagagcaacagagaggggtttttaaactgcaagggcctgagcagaggtctgccaattttttccatccctggaacctttctttaaatgaattcttccatgtaaaagaaagaaaccagagccactctgttgaagtggcagttaggggccaggcagccccactggggtggtctttctctgtctccccattccaggaggcctggagacacttgcagaatgctcacgcacctgagagcacatttttaaatccatcaggctaataataatcataacaatcataattgccatcatattcaaccagtggttcaggcactgctaaatgtggagtagctcacctggtttaatcctcacagcagcatcaagagtgtaagtgctgtggttatccacattctacagagtcattcaacaaataccaaaaaaggactaagttctggacacttcctctgacacttaaatcttcaacaaagaatataaagggccaagtgtcgtggctcacacatgtaatcccagcactttaggaggctgaggtgggaggattgcttgaggccaggagttcaagaccagcctgggcaacatagcaagactcccatctccacacacacacaaaaaaattatccaggaccagctgcagtggctcacacctgtaatcccagcactttgggaggccgaggtagaaggatcacttgagcccaggagtttgtttgagaccagcctgggcaacatagtgagaccccatctctattttaaaaaaactaaaaataaaaacatattagccaagtgtggtggcacccacctgtagtcccagtccctccctacttgggaggctgagatgggaggatggcttgagctcaggagttggaggctgcagagacctatgattgcacacctgcactcctgtctgggcgacagaccaagaccctgtttccaaaaaagctgggggcaaagaatataaagatttttgccttcctagactacattgggaggggagggagaaaacaaataaatagaaaaaataatgaaaatgctaagtgatatggtatgtcagaagtgctatggggaaaaataaagcaaggaagagggatacggagagccagggagttgcaattttaaaataaagtcattataggaggcctcattgagaaggagacatttgagcaagaactcaaaagtgagtggtttagccacgtggaaaacagagggaagagtgttgcaggtgtagggaacagcaatgcaaaatcctgaagcagcagcatgtctggcctgtggaggaactgcaaggaggccagtgggcggagtggagggaactaagaaggtgtagctggaaatgagattggacaggtcaccttgcctagcgtctcatacaggccagaactttgtcttttgctcgagtgagatgggcaccattgcaggattttgagcagagaaggaccatgatcaggctggttttgaatgactctggctgctatattgaaaacatgaggggaggggcacctggggtaggcaatagtggaaacagagagacctgttaagaagttaccgcagcaatccaggccgggcagcagtggctcacgcctgtaattccagcactttgggaggctgaggccagcatatcccctgagctcaggaatctgagaccagcctggctaacatggtgaaatcctgtgtccactaaaaatacaaaaattagctgggcgtggtggtgcgtgcttctagtcccagctactcctgaggtgggagaatcgctcaaacccaggaggcggaggttccagtgggccgagatcgcgccacgcactctagcctgggcgacagagcgagactatctcaaaacaaccaaccaaaaacccaaaatacaaacaacaacaacaaaaggagttactgcaacaatccagatggagaaactgaggcacggaaagatgaaatagcagagttagtagatagcccagcgaggatttgaatccagatactctgactccagcagccccctcttggccgctcccctctggtccctggccaccagcaaggaccccggtctgccctgggcctaaggcctttgtggttccctccctgcaggaagtgtaaccgagggccgggcggcaccggatatcgtgcaccaggttcgcgtggacgctggggggtccttcctgtcctgtgagctgcggccccgcgcactgcgcaagcgggatgtatctgtgcgccgagacgcgcccgccttctacccgctgcaataccgcaggcgcgagctgcgcttcaacctgaccgccaatcagcacctgctggcgcccggctttgtgagcgagatgccgcggcgcggcgccctgggtcgcgcgcacatccgggcccacacccccgcctgccacctgcttggcgaggtgcaggactccgagctcgagggtggcctggcggccatcagcgcctgcgacggcctggtgagtgagctgggacatgtatacttggggcagtctcgggtggtgggatgtggagattggctctagccttgccacgcacttgtctggtggctttgcccagtgcactttttctctgccagcctcggtattcacgcctgtaaagtgggagtgacaacgcaggcctcgttcatctctaggacaacagttctcaaagtttaatgtgaaagccgggtggtggtgcacctgtagtcccagctatttgggaggctgaggcgaaaggatcacttgagcccaggagttaaaggatgtaggacgtagggtgtgatcatggcgcttagctggagacacagcgagaccccaggcactaaaaaaaaaaaaaaaaaagaaagaaagaaagagaaaagaaaagaaaagtttaatatgagctcaaatcacctgcaggccctgtttaaacagaatttttgcagggtaggtctggaatggcgcccaaacacttggatttctgaaaacgtctcaggtaatattgaagatgcaggtccagagatcccattttgagaacctctgtttgactggactaagtaactgaaaaagcagttgacttctcttccttggggcatcagttatgactgttccttcacaggtccctttaggctgcttttctccaggaaagccacccctcaccctgtagccattctgcagggtgtggtgaggaacccctttcagcccctctgctcggatcagagctccgggaaaagcaggcctcagcttcctggtttcgactggctgaagggtggtgctggctactgcagccctaattgctccctgattgggtgctgattagagcagcttccactccaggcagagtagggcccctttctgttcgtgttcaggtgaccagccccactctcccagctctggagggtgggggtttgggaggagtaggggatgtgtgcacactctcagcgtccactgttcccaggaggccctcagcttagattgctcaggcaaaaaccatgggctgtggccgcacagggcctaatgacagggcagcccacaacgcaagctgcacaacgtctggacctttgaaggcccatctgccctgcacagtattcccatttatggagcctgtgcctgtcccttaatgtacaattgatcttgttgagcctgtgccacagctgtgcacatggggcatcattcccatttcacagatgaggaaacaggctcagaggggaacttgcccaggctcacctagtcattcagtgagtggtgggcgggagggggggacttcgcattcatacccaggtctccagacccaagagctgatgcactctccagccctccctccaggccccctggtcctgtgtgactcaaggggcagaattggtgcctatgaggggaagtccgagggatgtaaaaccttctttcctgttggagccctgagcttcctcaggaggtagtgggcatcatagatgcttcctggggcccctcccctccctggactctgaatgttggcggacatgtccaagacactcctgccagcttcccttctctgggcagccctgggcccagagaacagggtgtcctggtggccgtgggcatctccgccactcgggtgtgggtgtggatgcttttggagtgattcattgccttagggagatagagggaaggtcagaagccctggccagctgggagggagcacagtgctggaaatggctggcctgcagagaagacgcagaatagcctggaggcctgggcacaagctgccctgctcaggacagctgtctgggactttggaagacaccattttgtcagatttgggtgcagacccgttttcctctcctaatagggtgggtgtgtggggcagcatccccaggggcggaggcttctgagctccgctttgaaggtttggctgtgtgtgaaatggcagagaagggctttccagatggaggctacagagtgagcaaaggcccagcaggcggaaagtgcagggtgtctgtgggcagtcacagatgatgtgggcagtgggggctcagctgagcaggatgggcctctgggacgtgcaggaagagcagctgagggccagccctccctgtgtgaccctggtgcttcttccctagaaaggtgtgttcctgctctccaacaaggactacttcattcagcccctggacggtgccccagcctggcccagccatgcccagccccatgtggtgtacaagcatccggccccggagaggctggcacagcggggtgattccagtgctccaagtacctgtggggtgcaaggtatgctcttctactcccagttctcaggcaggtgctaggcctggggacatgaaggggcctttctagaagcccctcgtaacatgcccatgctcggtgtcccttagaccagaggatacagacagacagacggatacatcactatagcgtgtgcccttaattgtgccacaagactgtgtcctctgcctttcaggcctgtcccagtcagtcccctagactgacctccctctctccatctcacctacttctcccaccttggggctcaacctccctcttgctccctccccaccaagcctatggcacctggctctgccagccattctccctccagtgtccagaccaggtgagccatgcccagctccaacagggccattagccaggaacctccctccccatgccaccctgctcccaccctagaataactaacctctattattgggacctggagtgtggtacccagtgcctcctctgcagagcagcagtagtgccggccagtccaggtgaagagctgcctgctaagggttgctgggatttggggaatgcttggctggcatgccaatctcaggctgcccacagctctggtactccatttgctggagcacatatccacagaggcatgcttcttggcctcattttccccagcttcatagatgtgcttcctcttctgatctggagcagcctgggtcaggggagcaggctcagtagggcaagctgggctgggtcttggccagcctccccaggctggggtttagagggtggggtcaggggtcagtgttgagatgcactaagcccccagggtgggaggaagtgacacggggagataggggcccagtagccagctttgtcaagcccaggagttcccctcccatggacacagtactttactgcgtttatatccaccatttcatttaccctttgaggtccccccatgaggcagatcaacttattcctatttttagtcagggaatctcaagatcaaagaaagaaagtggtcaggcagagccacacagcacaggtttggggcagagccaggaggggaattcaggcccctcgcctctgatccctgtgtggttcccagtgccccagagaactcgctgaggagaagccctggagacgtgtgccctgggccaggatgggccagaaggatggggaacagatgttccctcaggatcagatgtttatttaagactgacttgttgagagccatcgctctacctgggataaggtgatggatgtggaagagcatgattctgcatgtggggactctgtctcattgtagcatttcccaaggaatatttcagggagtgtgttccaaagaatgccagtagtgcactgtgaaaaaaaaagatgctgctgttgaataagtttggccacacagggttaaaaaaagtaaaacgggccaggcatggtggtgcacacctgtagtcccagctacttgaggggctgaggtgggaggattgcttgagcccaggaggtcgaggctgcagcggctgcagtgagctgagatcatgcaactgcactccatatggatgacaaagtgagacactgtctcgaaaaaaaaaaaaaaaaaaaaaggtaaaacagacttcgttactacaggacttctcagagccctcaaagtaaatattcattgagaatccccaacagaataggcaggcagcattccccaaatttaggaaataagcaggggctttgaagcagtgaaacctgggttctgagcccagcttcaccctctctttgagcttcagttacttcatttgtaaaatgaggataattgtgcctacctcagaagtaagattaaatgagataatgcatgctaagcccccagcacagggactgtacatgttaggctcgatcaaggttggctgtggctatttttttggctgctgcagtatctgacccacagccaccttcaggacagcctcatctttctttaccaacgccacctacagaccccaatttatccgtgttctccctgtgctagactcagatctgagtcctagagcttgggtgggtttgtcccaaggatagcaagacaggtcccttttcaccctattttctttttttttttttttttttttgagatggagtctcactctgtcccccaggtcggagtgcagtggcgtgatctcagctcactgcaacctccgccttctggttcaagcgattttcctgcctcagcctcctgagcagctgggactacaggcgcatgccaccacactcagctaatttttttgtatttttagtagagatgggatttctccatgttaaccaggctggtctcgagctcctgacctcgtgatttgcccacctcagcctcccaaagtgccgagattacaggtatgagccaccgtgctcagccagtttcaccccattttcacccccaattctgttcttactctctgaggccacaagcccttttcgaggggctcttgtcacactttcagctcaccaggagcctgtggttatctgtaacctccagatcttaccttcacaaacactgcacacctctggcatgctctccagacctgcagcagaacagggctgggcttccctggatatcatttatccagttgaaacaccccacattgaccttgggccattaaccaatgttacttggttgagttgatcagccaattaagaccctgcctccctccaacatctcccaatgcctgtattacccccatagctcctgggagacagtgaggttatatatgctgagggaaggcctttgtggtggcactaagctgcccctagccctgactcagaatatagcttgggtcagtcctcaggcaggcagagcagaccctcaggggcttctggtcctctggagccactttgctggggactgataccaagcttacctgtctgtggtctaggaaagatttgtggtctgggaaggggcgtcggaggcctcttgtcctctgtaggttctgctgctgccacattggggcagtgcgtgtgaggtgtggggacactcatgcattggtgcatgtgcattgcctatccgctgtgcagcctgtgtgcacccgtgtgagcgtccctgtgtgtgagcacaggtgtgcattgccctgggtgggtgggtggcttggggtgggcattggctgcttgtatccttcatcctggtgacagcctgaccccctcatctcttgggcaggtggctggcctgtttcacgaccccagcattgggaaccccatccacatgaccattgtgctcctggtccttctggaagatgaggaggtgagcggtcatgtggtcccacgctgcctggcaatggcttcggctgccagagccctcctgccccatgacctgtgctgctctgtatggaagggcacagtgaaggcctccttggactggactgtgtcccctgccactccctggttcctgactgaccctctctcaggtcccaggtctcctgcaggaggttcctacaggagggatggtcaggccggaagctggactggtgcctgcgggcctcccactgccctgctgggcctctgtctcctgcctttgtatgggggagaattgggcctgaccttcttggaactcaggggaggcatgagcagtcactctctctgcccccaggaggacctaaagatcatgcaccatgcagacaacaccctgaagagcttctgcaagtggcagaaaagcatcaacatgaagggagacgcccaccccctgcagcatgacactgccatcctgctcatcaggtactgcagctgcaggagggtgggagcctgcatctcagggaggtgcttcccagccctagggaagaagccctggtggaggagggggccgtgctgtcagggagccccattttgaggagagtttgcgcacctttggcccaaggctggattctgtccgcacttagggaggtctttttattttgaaataattgtggattctcacactcttgtcaaaaataatagagagagggcctgtatagccttcatccatttcccccggtggtaacatcttgcatgactacagcacagtatcccaatcaggaaactgacactgataccatccacagacttactcaggtctcatcggttccacatgtacttccctgtgtgtgtgtgtgtgtgtgtgtgtgtgtgtgtgtattcagttctgtgcagtttcatcactgtgggttcacctacccacccccacagtctagatacagatctgtcccatcagaaggatgtctcgtgctacccgtttatagtcacagccaccttcctccctcctcccctaacctccggcaactgctgatctgtccagaggcagttattttccctctgctggactctggcagcttctgtcagtgcccctgctggatagtaaccaaaattattctgtgcaggtctgtgttcctgagggccaaagagatgcccagtggcttgtgtgtgaatgagaatacctccttcccaagtggccactgtgctggcctcatgtcacagaatggtgggaaggacatccttttcacttgggatcaactgggggtgacccttccctggccttaactcaggtgggcctggcactcgctaggttagcctgaaggccgcttctctgcctgtgcaggaaggacctgtgtgcagccatgaactggccctgtgagaccctgggcttgtcccatgtggtgggcatgtgccagctgcaccgtagctgcaacatcaaggaggacatgggcctgccgctgaccttcactgtgatggcccctgcaagctcactggcctcaagaacagtcttgagcacaggtaccgtgcctgcccctattgctacactgagagtcgagattcaccctcccagcctgagagcactgggtatccagcctgtgggtcacaaagtccaggggaaaggaagctctctggagaagaagccccgactgtctggccatgtgctgcccctgcactgtgccctccccacaaccaggcttccctgttaaacaggagagagtcctgcctgggcatctctgggactggcctggagggagtcttatttaaaggggagttgtgatgggctggaaagtcattgtaggtctttggctgtccctccccattgccctcagtgctgtattttttactctcgatccctgtccctgttcctgtttgctctgtggcctgggccagtgcctgccctctctgggcctctgtgtgcttcccatagattgaggggtttggattcagtgatgtccaaggctccctctatctgacaccgctgcctaaggctcctgtcttcacaggcctccagccacctgtgccctggctgttgagctggcgaatatggcagcatcttagattgtctagaaagccatcaaaggcaggctcccagagggttctgtgggtcaaagctgttggggtcatccattcagatgtccgggttttgtgggtgatggccgtgcctgcaggaccttgaagctgcttatggctgcagaaagaacagcctgccgcagtactacaatttcctggctgtgttaccctggctagttccttagactctctgagccttcctgagggtaataatgagaactgagtgagactgtgtttctgaaagtgcttagcatggccccggcacatagtagatgctcaggaaataatttttctcatgtccttcccaaggatggtctctggagacctttctgtgatacagcagctcagatgccttaactcaagtgcacagccttgggacaaggacctgtgagtgggaaccgctgtcagactgttcttgaggccagtgagcttgcaggggccatcacgggcccacatctgtgccacctgatttgccattgctggccagtccccgggctggagcagggctgctctgggtccctggccctcatttcaggctcaggccggagtaggagcccttgggatactagctgtcataccctcattttacattaaagaaactgaggctcagcgagagaatgtgactttctcaaggctgtggccattgagtggcacaaccagccctgggaactaggactatgcaccttgtggttctccagggtagggcaggctagaagcctcccgccggcttacccgcccttggggcctgtgctctcacacagttttggcattcagcatgatggaagcagcaatgactgtgaacccattggaaacagcctttcatcatgtttccacagctcccgtacgacgccgctcccctcacctggtcctgctgcagctgccagtacatcaccaggttccttgagtaagtccctcccccagccctgagcccctacgccttgatccatgagatcaaggtctaatgggggagatgcagacagtcacactgcagggtcggggtagagggaagcagaggggcaaggtctcgatccatgaggtcaaggtctactaggaaagatgcagacagtcatactgcagggccgtggtagagggaagcagaagggcaaggtcttgatctgtgaggtcaaggtctaatgggggagatgcagacagtcatactgcagggccagggtagaaggaagcagaggggcatctggcaaaaatgtgctggcatcccaaatgtcctcctggaagggacacttgagcttgaacttggagaaggagtgagaattcacacatgtgcagaagggagaagaatggcgttcctggtagaggaagcctgagaaaggcctgcagcggtaaaggagtgggagagctttcagggaacggcagaaccgtaaaggagtgggagagctttcagggaacggcagaaccctgagcgaggctatgggagccaaggctgcgtaggaaataaggctggaggaggcgagggccagccacagtgtccagtgagaggcaggaagaaggggccactaagggaactgaaatacaaagctttctcctttttttcatgttctcttcacttgttctgatgttcttgttgttgttgtttgtttgttttttgagacagagtctcactctattgcccaggctggagtgccatggtgcaatctcggctcactgcaacctctgcctcccaggttcaagcgattctcctgcctcagactcctgagtagctggaactacaggcatgtgccacaatgcctggttaatttttatatttttagtagagacggggttttgtcatgttggccagactggtcttgaactcctgacctcaggtgatctgcccacctcggcctcccagagtgctggaattacaggcgtgagccaccatgcccagcctgttctgctggttttgttttgctttgttttgctttttaatttgctatttaatgttgttctaagtaagaaaaagttttacatttaaattattagcataaattttaccattcatctttattttgtgcagtgccagttttaaatgcaaatgtaagagtacagttgacccagaacaacttgggggtcaggggtgctgacctctgtgcaactgaaaatccatgtataactttgactcgcccaaaactactaatagcctactgttgactggaagccttactgataacataaacagttaatacatattttgtatgttatatataatatatactatattcttacaataaagtaagctagagaaaagcaaatgttattgaaatcataaggaagaggaaatacgttcactgttaattaagtggaagtggatcatcataaagatctccatcctcatcctcttcatgttgagtacgctgaggagggaggagaaaggcagggggtgatcttcttgtcttggggtggcagaggtggaaaaaaatccacacataagtggaccccgttgttcaaaagtcagctgtattaacttgtatgcagggtaaccaaaattacacaattcgtcttttgtagctgatatttactagatgatgagatagaataaaactatctcaattggtttgatctcactccttgatatgtgcacattctacccaggctctctaccttttcttaccgatgaagatggaaagactgaaaggagaaggaactatggggttctctttcctcccatgtcttcattttctgcatagcagttggctaatacaggggtgttaacatgggagagaaaggatgatggggcttcttggtcattgtcttctttctgcatttgaagtaatggttcaaatggaaaatgcagcctctgggcctgtcagtgccccctgtcccttactcagttgttgacataacatgtttatcttctaattgctttgagtctcaccgaactcctacacattatagattctgacatggaccaaagtaaatgttagatgcaagtggggcagcaaggaatggtggacacagacactgcctgtgtctcctctgttcaaacacaggcttctttgtcccatcagaccttgcttactggccaggcgcagtggctcacgcctgtaatcccagcactttgtgaggccgaggtgggtggatcacctgaggtcaggagttttagaccagcctggccaacatggtgaaaccccctctctactaaaaatataaaaaattagctgggtgtggtggcggatgcctgtaatcccagctactcaggagcctgaggcaggagaattgcttgaacccgggaggtggaggctgcagtgagccaagattgagctgctgcactccagcctgggcaacaagagcaaaaaaactctgtctcaaaaaaaaaaaaaaagaatagaagatggcaacagcagagcattgcatacctgccccacttctccccaccctccattgctttttgctaggcaaacaccttcaaacttaacacttttagctctttcttgtgtttactttcctatttccgaaaagcactgctagactctcatttattgattttccagtttagatattatctagaaggttgggatttagcacccttgcatcacttcctatacgtacatttgtcccctcacctttcatcccaatttagtgttaacatacttggattaagtccatattctgcattttcattattatggctgtaaatcttgatggctgaactaagtgttgtaataagatggcatttcttttttttaatttattttttattttgagagtgtctcattctgttgccctggctggagtacagtggtgcaatctcggctcatactgcagcctccacctcccaggttcaagctattctcatgcctcagcctcccaagtagctgggattacaggcacctgccaccacgcccagcatatgtttgtatttttagtagaggcgggatttctgtgttggccaggttggtctcaaactcctgacctcaagtgattcgccaccttagcctcccaaagtgctaggattacaggcgtgagccactgtgccccatctagacggcatttctttgtaagaacaagcttttatttgcttggttttcattgcttctccaggccttccagatcctttaacagttttataagatgtctcttaatccagttttcccaaaggtaatctctaccagataatccagccgttcccttctttcctggaccctcctcccaacttccctctgtcctccagtttagactggatgctttctatgcctgccccaaaatattcatggagggtcctgtttctcggatcccatgctacttttttttatgggcaggtaccttttttttttttaatttgttttggtggagcacatcctcaagtagctttctgagaaagagcgcatggaggtaaatggtttgcctgtctcaaagtgtctttattcttccctcacatctgattgatattttgatttgatatcaacttctgggttggaagtgactcttcctcagaatgttgaaggcatttttctgttgtcttctagtttccaacattgctctgaagaggtcccataccatttggatttgaatgtgaccttttaaaaaatctggaagcttttaggactctttctctttctctctctctttttggtgattttaaattttaaatatatgccttggtctattttaatttgagggagcactcattggactgttttaatctagaaacttgtgcccttcagtgattgaactgttggtgtattattgatttgataactttcttacattttctctttctggaacccttaatattcagctattctctcactttcttatttttaaacattttacacttcttcatctctttctcttttcttttctatcctccctctctcccttctctctctttcactcccttcctctctccctccctccctccctccttccctcctccctccctccctccctccctcccttccttccttccttccgtccttccttccctccttccttccttccttccttccttttgagtctcgctttgttgcccaggctggagtgcagtgccacaatcatggctcactgcagcctcgagctcccaggcacaaatgatcctcctgcctcagcatcccaagtagctgggactacaggtgtatgccaccacactcagctaattttttaatttttctgtagagatggggttttgccatgctgcttaggctggacttgaactcctggaatcctctctcagtctcccatagttctgggattacaagcgttagccaccgtgcctagccatctctattttctaggaggtatctgactctactttacaatccctctattaaatttttgatttttttcattgtacttttaatttcttgaactttctcactcactaaatacacattgcgtgtctcatatctgaaatacttgggaccagaagtgttttagattttggattttttttttttattattttggagtatttccattatacttaccagttcagaatccccagtctgaaagtccaaaatctgaagtgctccaaagagaatttcctctgagcatcatgttagtgcccaaaagttttggattttggagcatttggattttgggattggagatactcaacctgtgcaccttttgatcctattcctgttttgtgggtacagtgtgttctcttatctctgtgaggttattacttacacggatttgacttttttcttctgttccctgaaatgtttttatttcctttgggttatttaaaaaaatatatttgtttcatgttaacagttttcttggccaggcatggtggctcacgcctgtaatcccagcactttgggaggccgaggcaggcagatctcttgaggtcaggagttcgagaccagcctgaccaacatggtgaaatcctgtctctactaaaaaaaatacaaaaaattagctgggcatggtggctcatgcctgtaattgcagctactcaggaggctgaggcaggagaatcgcttgaacccgggagggaaaggctgcagtgaaccaagattctgccactgtactccagcctgggcaaaagagagagactctgtctcaaagaaaagttttcttaaaatgcattggctgtatttcatatatagcaaggagatgcagagacactaattgggcagtttgtggacttgggcaggacttttccaagtcactgctgaaggactggttcagatggggctattttggggagatcctctaatgtcactatctgaggtcatttttctgagtgattcagtttcctgagaggaatcctctcgacttttcctgggagagtgtatgtctggctgcagcattccagcatccaagtgggaaaggggcttggcgtgtttcttacccttcaatgtgtagacttttgcttgtccccttttctctgtaggtccttctgccttgggccttcatgtgtgtccaccgttcctgggccagagcctcctggttcaccctctccaggaagtgatccctggccctctgctgggtggcaggtggccgtcacttggctactcagggttggggaggggctctagggtctgatcggttcttacagactttcagccctactgtcttcagccctcctggccgtaaggccctgaggagtccctgcaaactcagttcctgagccttttcgggcttctgcttctgggtggttcccccctgcaggaatctgactctcagctttcatcactctagcaagtcagctactgcctggccatctgcttcccagcttccagaatcttgttgacatccttcattactcatcatcaccccttatggatttatgccttgtttatttcctctactgtcattatagtggagtcttggaaggaagcagcgataaatctgtctgctcaatgtgccatgtttttctagaagtccactcactgtggggcttaagcagggatgtgaccaggtccattagggatgtaagagcaaggatactggcctccagtggaagagggattactggggtggggggtgggattggaagcagagaagagttttgtttggtggttaagaacctagactggcctgtccaagagggttgacctgaagaactctaagaacctttctgggctgacaggtgctttatgggaccttggggagaggtcacagcatttcgccagtgtcaacttggacctgggtggggaggaggggaggccctggtccctggtttcctcaaagccagcatttctacagggagagaggcaggctaggtaacatgtggggtccttcacttcaccccatggacaccccatgcagtgactccatgaccagatcccaggggtggccaggggagcgggcccacatgtctctcctgtcagtggtgggcagctctttgcagtcttgaggtgagagtgaagcttctgactggagtcacctactgtctgctttgacctcttgtgggactgcccagccctgctatagttagcttcaggaggggcgtggaggggaagggctgatggtttgggggatccgggtgtgtcggcagtgcagagaacctggcagtcagcctgccagaggaaggaagggctggctgacggccaccttgagtttctgactcccaagacagcacctgggcctgattctggcagtggattctgtgagggtcaccttatgctcccaacttctcccaacatccagggtgggctgagaggttgttgcggcttcagctgcccagcagcaggcctgcaggagccacatgtgcagcgagtcagcactggggcagccaggaaacaaaagggctcggctgcagcccagggactgttggtgccgggatgaggcgcattggacccctcagcccctgggtcagaggaccccctggctgggatgggtgagcccccagtctacctcctcgagccacggaatgatggcgggaaggagggagcccagggccagctgaccccaccacccccggctgacactctgccccgggtgcaggcccagggaggctcagggagccccaagccgcaggagaacttgggacactcctttctccctgccaggcctcgctgccatggttttgaacttgtatgtggggtgaagtatttgaggccaggctcgcagttgaatgggaggagccctgcactgggggtagcccagtgagtagacacagcctggtgcaggcagcctgggcctggctccaggtcctggccatcacgtccctcttgcgcgacccgggacaagtgacgtatgggccctgagtgcatgagggaagatgatggtagagtctgcccaggatgttgtgaggagcaaatgagagggtatgcccccagcaccctggaccagtctggcacgtggtcatcttgggcactaggactgcatccagcagctgctcatctgccaacgcccatgttagaggatctgtttccagccatgatgggcagtctgagtgattccaggaggattccagggttctcagtagaagtctggtcaccttggctttcttctccgcagctctgggcagagtcaggggcctgtcactggccaggggacttaggagaccacacagaccacccaccccaccctgggtctcccagctgccaggccccctcctctgaaatctgggcttcgggattccatggtctgatccaccctcctagcctctctccacacctgtcttcagcactcttggccctgtttcctgaccctttcgtgttctcccagcctctccacatctcggagtgtctctttctctccctgctggactccaggatccatcacctttgcccttcttccctgtgcgaccccctgcctgtcccaatcaggactgtatgctcatcccagccatctggcctggcaccacctaccctgagtccacccagactggagaactggagggattttgcctccccatctcccctgcctggctagaggccccaggtcccatgggtcctgcctccttccatgcttctgcccaagtcgtggctgcctgggtcatccccagccccgcatgtctgcatggctcaattctccccagccactgctgccccacagagggccccaaaccttcctccaggacagcaatgagctgtgggtgggctggtcagcatgccagggcactcctgctgctaagccgttgtagtggccgcctaaggtccagcaggtacagcaggctggtcactggtcccagaagcagtagcatgcctgagggctgtacagagtgaggcaggggcagaagcaggtgccagctgggcctgggccgccctccccagggccccggactccacgctcgctgcctcgtggtggtctgggcagccttgtcttcgccacaccgcagcagcaggagcgtgtggtggacacagatggcacctgctcgtgtctgccagtttccccgccaccgctgccagggaatgccagctggaggaaggcaggagtagatagggtatgacagaggctggaggccagccctgttggggagtgggggaaacaggggacaggcacggatgccctaggctctctcccaggggaggggctgctttccagaccttgcccttccacagatgacccgaggtctctgcctgggtggggccgtcggaggctctgttgtgtcaactgtgatgtgatattctccggatccttgtcgggcctggctccagggtctgggctcagacacggaggctgcagggtcggagagcagggccacatgagggtttggcggtccaggaggccttctgagggaagggccctggcagcgtgtgcagaggcctgggattggggttggggttgtttagccagctggagtgcccaggaggtgagatgagattggctgggagggcctgtgctactggctgcaggtggaggatcggctgagccgagcggggaggctggagtttcctacagttgtagggctctgtgccccctcccacctctcctcctctcctggccccaccgaggcttctccgatgggtctcacaggctgcgcccccctccatcctcccgtcccatctctagccatgggtggagcctgtgcctggatgacccgcctgccaaggacatcattgacttcccatcagtgctgcctggggtcctctatgatgtgagccaccagtgccacctccagtatggggcctactctgccttctgcgaggacatggatgtgagtggggccggtgtgggtgtgggggtgtggggacccgacaggagggcttaggggacagctttcaccagcctgtggatgccagcttgggagcaacctcgcctgggctgggctacgcccctgagtgacactgtgagacgtcaagtggcctgtgggagaggccagggatgggcggccacagacccagctctgaattctgggtcaaccatggaccgactgtgacccctcgggcaagtcccttcgcctctctggagctggctcataagagggaaaaggaacccctgtggggagggtctatttatcctggcgaagatcgcctgaagtgatcttctaacaggagtgtttccagaggaggcgctgggccgggagaggtgtggacagctgaggaccactctgagcagtgcagccccgggcgccccacaccaccacgtggtctggggaggaaggtgggagcagacacacaagaagggacctctgggggtctgtgggcccctgccatgtggaggggtgcccagggacccttggggacagggaggggggcagggtgggtggcggcactggggagggggtgaggctatggcccatgccctcctcctcgcagaatgtctgccacacactctggtgctctgtggggaccacctgtcactccaagctggatgcagccgtggacggcatccggtgtggggagaataaggtaggcgatgttcccagtcccggcagtggatgtgtgagaggccagacctcctgctgtgaccgggccctggagtcagccccggctcacagagagccccatgccctctgcagcccaagcccccgtctgcaaagtggaggcattggggccagggcttgattccatgattctccagggtgtcttcagctgagtcagcacgtgggctgttttactccctgctcagcgcctccatgtggcctgggtcacagatgattgtgatgattgcgagggggcctctctcaccttccatccttcccctctgtgccttttgcagcattctcacacaccttgttctcactagggtgaggatgactgataggcttgggggtggggtggctctacctccgtctgtctcggtagtggtgtctcaatggggagtgcatacctgtgggcttccagcccgaggccatggatggtggctggtctggctggagcgcctggtccatctgctcacggagctgtggcgtgggcatacagagagccaagcagcagtgcatgcagcctatgtgagtgtggggcccagggtgccctgggcaatgggacagagggacccaggcagtcagccgattgcaggagcttggctctgtgccagcccctggctcttagaagtgtcctcataatggtcagtctgagtgtccaggccaccttgagtcactttcaaggagtgttctgagggctgacagggtccccactgctgacccctttgcagaaagggggacactgaggcccagagactggagagactcagcagaggccacgtggcaaagcagctgctggctggaaggaggcaggagagggcagtggggaagagcatgggccctggaccttagatggctcagggttcgaatcccctcttcaccccttctctgggcctccgtttccccacctgtataatagcagtgcccatccagtaaagttgtagtcaggggcaaatgcagtttatgcaggccagcccctcagccctgcagctcatctgtagtgggcactcagcaggaggggcttggtggcctcagaggcacaacaagggcctgagatgagatggagcagctgggaggatgggacagcactgaaggggtggcctgaggtgagtgacttcacctctctggatctctgtttccccatctaaatgggggggcgcagggggtgtgaagatctggtgagaagcagaggccagtggtactgtagaccgaggcactacccggctgatcttcacttcaggaggccacccggggcaggcatggggttcacagtcggccccacccagggccctgcgcttacccaagactggcctgtgcccctccctgcctcctggcctccaggtctgagctgagtggaggccagcgaccctggcctaaatgtggaggatttcaggagctgtgctccatcatacctttcagctggctggggccctgggcgcttcctttagacccaggctgggggtactgccaccaggaggaaggctgaggactcaagggctcgttaggatgctggtgtcatgggctggagactcggattagtccctccagccagtgccagtcatgcctgcagcttgtcccagcttctcaacagccctctgcaggggcagccccaaccccactttatacatgaggaaactgaggcccagagggtggccgaagacttgtccacgatcacacagcaggttgggggcagagctcaggcttcctgctgccacctccccacaggtccctacagacagggagggtgtgtctgggccacagggtgggcaacccaagggagggaagcagcgtgcacaaagctgggcagcagggatcttggggtgtgggtgcaggaggaagctgcttgctctgggctgtggccatgcagtagcactcactgggccctcactggggtccaccccggttctccccacaggcccagatacaaaggcagatactgtgtgggtaagcggaagcgcttccgcctctgcaacctgcaggcctgccccgctggccgcccctccttccgccacgtccagtgcagccactttgacgctatgctctacgagggccagctgcacacatgggtgcccatggtcaatgacggtgagtgctgcctcccatggaaacattgagactcagagggcggcgagcggggtgtgggtccaaggttaccctgtgatgcaagcaggagacccagtctccaccccaagcctgggccactcccactgtcccctggggctgctgctcgcccctagctccccaatctgcagccttgcagatagctaccagcccagccggagcctccagcatgtttgtgctgcttgggagcctccagcctgccatggatgtgtgtcacggaggggtcttcctggtggcctccatactcccgctccagctgttgctgatgactcttctacttgggcccccagtgaacccctgtgagctgcactgccggcccgcgaatgagtactttgccaagaagctgcgggacgccgtggttgatggcaccccctgctaccaggtccgagccagccgggacctctgcatcaatggcatctgtaaggtgtgcctggttaggaagaggctctcccagcactgcctgcccccagccccactggcgggccccaggttctctcctggtcctcctcgggccaccctccccatgctctaccattgggcttcccagcccctaccctctatgacctctaaggcaaagcccctaccacgcctcctggcactggggaccccccccagtcaggcctcgccccactgcgtctccttggatgcctgcaccagcaccgccccagccaggaaaccggagcccaggcagtggcttgacctcttgctggctggctgaccccaggcagtggcttgacctcttgctggctggctgaccccaggcagtggtttgctccctgatagaggggttaaatgaggtggcacaggtgacatgaagggctctgagccccgaagagtaggcctcagtgtttggtaacaatttatattcttatttttaataacaacgatggcctctcctctttacccatgtctccagccacctacttgtccttgcttcttgccctctaaaccactggggtatcaaggcctgggctccgaggaggaccaggagggaggtgccaacccccagtgcctttgacgttgaaattccctgcacgcgctgctcaggagcccgtggcgtgtcagatcccctgcctgcccgcaggctttgcagaactcttcccttctcttgtctcttgtgatgctcatgacatgcctttaagggaggggtgggtctccctgtctcacatctgaggaaactgaggctcagggaggtagagaagttcacctgggtcagaggcacagctggggtggggcagggccagagagaggcctcccgacccccactcccagctttcttctcctgaccctggctggcccccggggctggggccacagagggctggccgccagcaccaggggcctcccctcctcgtgtgttgcagaacgtggggctgtgactttgagattgactctggcactatggaggaccgctgtggcgtgtgccacggcaacggctccacctgccacaccgtgagtgggaccttcgaggaggccgagggcctgggtatggggtgggaccactgtggggaggggtgtgctcttcacctggtggccccttccccatctcccccgggcccctgtccttggcctcgtggcccccacccagcctagagatggctaagcagggagggcttgctggggtggattcttgcaggagtcaggggacccctggcccacacgcagagacctgtccccatggggagtcttcctgtcccagagaccccaggcagggccaccccgacttgtgtgtggcccctgggcctttcaaagaatggtcgtctcctcctgaatcttctgagacccccagctccatgccctcacctctggtctgttttgcacatgttgctgaagtactgactgtgtgctaggtgatgaggacatgcaggtgaagcgctcagtcctgaagggggacagaaccttctggtgtgatcagtgcagtggagggaggcccagagggctgtgggagcactgaagaagaaggtcctggcctggggaagtcagggaaggtttcctgcaggaggcggaagttgagctgaatcataaaactcagaagagatggaatgggcattccaaatggaggaaagagcttgcgccagagccctggaggcaagaagggaaggcagggccagctatggggccttgagtgccaggctgagaagcttagatttcatcccagagatgcagtgcagtgtggtggataaagcactggccctggaggctgcttatattgcagcaggacgctcatgcacgttactctccctgtctgcctcactttgctcatctgtaaaatggggttaacaatagtaccatgctatagggccattacccatgagcttacacatgtgaagtgctgagagtagtgcccggcacgtgatgggtgtgatggaagtgaatgaataaaagcaggctgcgtggggatgaggagggtgtcccaggagaaaggcctgggcactttggttttttttagaaagagaatgccagccggcccttagagtaggggatggatccagccttatgatgagaccagtttaggtccccaagagaggagtgacggggcatggccacggggtcaggatttgtggcacctccgcaaggttttggtgacccatgacagatccgagcaatttggggagctcagactttaaagctaatggcgaaatctttggcatcagcaggcggaggcaagtggggagagatgtgaggggagcaggtggggataagcaagcttctcaccccaggcacaacccttgcctgacagggtatgtggacgtggggctgatcccagccagcacacgtgaggtccgcatccaggaggtggctgaggctgccaacttcctggcactgcagagcgaggacccggagaagtacttcctcaatggtggctggaccatccagtagaacggggactaccaggtggcagggaccaccgtcacatacgcacgcaggggcaactgggagaacctcacgtccccgggtcccaccaaggagcctgtctggatccaggtgcctgcctcccgaggcccaggcgtggggagcagaggcggagtccccaggcccagcacctcccatggtaggtctcgtcctggaggagtgagccctgggttagtcacagagcctggctctgagccagaccctcctgctgaggcctctacctcggtttccccatctttaagatggcccaactgtgtagctgcagttcacagaggtggctggggtcagctcctttaagactgggtggatggagaagacacctcgtgctcacgggcccccgcctgcccacccagctgctgttccaggagagcaaccctggggtgcactacgagtacaccatccacagggaggcaggtggccacggcgaggtcccgccgcccgagttctcctggcactgtgggccctggaccaagtgtacagtcacctgtggcagaggtgagaagtggggcaggcacagccccgccagcaggggcttcatctctggacagggacaccggcttcagctcccagctcactgctgggccaccatgggtttagaagtttgcttctctgagcctcagttccccatctgtgagatgaggctagcaaccgccccatgtcccaggcccactgggagggtaaatggatgaggcaggtgggtgctggctcgcggcgtgtgctcagtgtgctgcagctcttggcgttctccctccagtggacacagctcccccttgattttgtccttgctcagctccggcaggttttgtgcctgcatttctgctgcgtcccggagaccagcccaggcccctcaccacactgacttatttccctgaactatttatgaaaagtagggcaatttcattaactccgactcttcctccccatatttccctcagtctccccccatgctcctcagtctcccctctctgtctctttgtctcctccccactgctcctcagtctcccctctgcccctccgtctcctcccatactcctcagtctccccccatgcctctcagtctccccccatacccctcggtctccccccatacccctcggtctgcccccatacccctcggtctccccccaatatccctcagtttccctccggccctccagtacccccgccacgcccctcagtcttcctcccccggctcggtctcccccgccattccttggtctccccccagccccccagtcccccccgacgccccttggtcttcctccccctgctcggtctgccctgctgttcctcgatctccccacacctcagtctccccctttgtctcttagtcctcccctttccccctcagtcttcccatcgttgacactcagtatcctcagggtctcagaatcgggaatctgatatacagacgtttgagcattccttcaaatgctattatgatgacaaagtgaaaatggagaactgggcagttaccttccaaagctaggaaacccattttatctaatacagctgtctttattttattttattttgttttattttattttatttgagatggagtctcactctgtcgcccaggctggagtgcagtggcgcgatcttggctcactgcagcctccgcctcccaggttccagcaattctccttcctcagcctcccgagtagctgggatttacaggcacgcaccaccatgcctggctaattttttattagtggtagagatggggtttcaccatgttggccaggctggtcttgaactgctgacctcaggtgattcgcccgccttggcctcccatagtgctgggattacaggcgtgagccactgtgcctggcctaatacaggtgtctttaattggacaaacgtgaaaaccaacaaatacatttgcagcactagacatttggggaattgcctttcagcaaattggctgcttcgcaggtggaccacttaggagcgtctgcagaggcaagtgccctgtggtggctggaagagacaggggttctttgtctcaggcaggaagtcccaggtgcacagtccaagctggcgggacctggagctgactggccctcagccacaccatccttgccatagcagcctcccctccactcctgcttgccacagatggtgtcctcccttccagggctcttgcagtgttctaggcaagaaggagagaggaaagggctgactcccagcgagggacttgtgcctttttctcctgagccaggactgtgtcccagacccccctagttgcaagggagcggcagtggggtgtgttttcagcaggtcccactgctgccttgaacaaaatcagactctgttggtgaggaaagagggggatggatgtgggactggcagctcaggggagggacaacttactctcgggaccacggggcagggggtggagcagagaaggcagagccaccagcagacggggtcctgcagctgggcctcaacaggcagtatggaagtgagtgtccaaggtgaggaacgtggctgtgcaaagtccccaggttggacagtggcagagaatgtaaaggactggagcagtgccaaggctggtgtggggatggagagcaggggctgtccattgatgccccatttcttgtccagacattctctgatccattgggaagggtgtggatggtgggaccgtgtgtcagtggtccctggacacactgggccctgaaggctcaggcagcggctcctctagccatgagctcttcagtgaggctgacttcatcctgcgccacctggccccatgcccttcacccgcctcatcacccaagccaatcccaggaaggagcagagggagctggtctttcattctcttcccaaggctgaagccccagaccccggtcacccctcactccagcctgggccaccctggacacttatggtcctcctctttgggtccctggatgtggaaataggcctcaggtcacattcagtttccctgaggggaaggtggcaggagccacggctgggtttgcatgctagcagcagctggcatggatcgagctcttaggatgtgccgggcacgggctgagcctgcacatgcaagaacacatgcagtcctccctccaggacatggaggaggcaggattgttgctcccacttcacagaggaggacgctgaggttcagagaggccaaatgagctgcccaggcatctcagctaggatgcagagggtctgggcacccaacccactaaacctccacactctgccacccctccaggggcagtcagaggggaagctacataggagagggggtgggtgagaaccaggaggacagcaaggaggcgacggtggaggtctgccttcatcctgacatgggcagtaaggcatcctgacatgggcagtaaggcgctgttctgggagggttctggcagagagggtgtctttgggtcttgggcggtgggcacctgggtgccagtcccaggctgaacgccatggcccctaggtgtgcagaggcagagtgtgtactgctcggagcggcaggcagggcccgtggacgaggagcactgtgaccccctgggccggcccgatgactgccagaggaagtgcagccagcagccctgccctgccaggtgagcccgcccccatcccctaccaactccccacccccaggcatcctgggtctgccacaggcccctacatctgggtccccagaggccccagggaggagcagagggagccgggctttcattctcttcccaaggctgaagccccaacccccggtcacctctcaccccagcctgggccagcctggacacctatggtcctcctctttgggtccctggatgtggaaataggcctcaggtcatgctcagtttccctgaggggaaggtggcaggagtggaggggctgtgccttgtcaccagactttgagggcaggacacttacctgagcttggagctctggagaatcatccactggcttctggcactgcccaaaccccgagggcctggaaacccagcctggccctccctgctggtgagcctgtcaatgccacctgtctgatgccatactgatgacacctgtgtgccctcagcaggtggtgggcaggtgagtggcagctgtgctccagctcctgcgggcctgggggcctctcctgccaggctgtgctctgcatccgcagcgtggggctggatgagcagagcgccctgaagccacccgcctgtgaacaccttccccggccccctactgaaaccccttgcaaccaccatgtgccctgtccggccacgtaggctgtggggaactggtctcaggtgagtgtgggatgggaaggtgcccgcctccagccccacccttggtcttcagctacagggaggcagacagccttcctggagaccttgtgggtgggagggaacctgggcattccagggtccagcccctgactctaaagcctcagggatcaggaagcccctggcaagcatggccacagtcatggccttgagctgggaagggccagagagggctggctggggtctctgccactctgacatcaggcagtggacaggttacccagccttgccccagcgtcccctggcagcctgcctcccaggctaagcccctcaccctggcttcccctgcagtgctcagtgacatatgaggaagggactcagcaccgaaatgtcctctgcatcagtgacaccggtgtcccctgtgacgaggcccagcagccagccagcgaagtcacctgctctctgccaccctgttggtggcccctggacacactgggccctgaaggctcaggcagcggctcctccagccacgagctcttcaacgaggctgacttcatcccgcgccacctggccccacgcccttcacccgcctcatcacccaagccaggcaccatgggcaacgccattgaggaggaggctccaaagctggacctgccggggcccgtgtttgtggacgacttctactacgactacaatttcatcagcttccacgaggatctgtccttacgggccttctgaggagcctgatctagacctggcggggacaggggatcggacgcccccaccacacagccgtcctgctgcgccctccacgggtagccctgtgcctgccacagagcctcctgcagccaaggaggaaggggcaacgggaccttggtccccgagcccttggcctagccaggccggccgctccccacccccaccctcagagcagacccctgggaaccctttgatcaatttcctgcctgaggaagacacccccataggggccccagatcttgggctccccagcctgccctggcccagggtttccactgatggcctgcagacgcctgccgcccctgagagccaaaatgatttcccagttggcaaggacagccagagccagctgccctctccatggcaggacaggaccaacgaggttttcaaatgatgagggacccaagggctgcggagcaccccacctgcccccgagacccagccccacgctgcccactttgtacccggtcagcagcacccactcctctcctagtcctgacgtggcggagctgtggacaggagggacagtagcctgggagtcagctctggagggtggcctggggcctgtggacagtgaactgtggcccactgttagggtggcttctctccctcctcctcccatagcccctttgccagagatgaagggcaaggacagtcccctgcagccggggacttccaccttcccaaccccaggaccaggctcatgggacctgcagactgtggcagtgtgggggaccttcctccccacaaccctgactggcctcgggcacacgcctgagcctgccctgaacccaggacccaagggtcagcctgagtccctcagccctgaggtgcccctgagctctaggctgctgtccatgccagcttgggacagccccgccaacagccacagagcccctgagacccagccactgcctcccagcctggctgaagcggggccccccacggacccgttggttgtcaggaacgccggctgacaagtgggaaactggagcgaggcaagtggtgtgggctgggcgggcagggagtttgcgcaggaccttggtgactatttcctcatctgaaaatgagcagagtgggacgcaggcgccgtctgtctcgccttccttggggcgggggttcccaggattaggggaatgaggggacctggggcccattcctgggcagcacagggggcctcagggaaggcaggggcaggcacactctggcagcacagcatgccccaggatggagctggctcagacagctgtgcagtggggagggtccctgtgtggccaccaggcccagtcctgcccagcaggcagcagcttccctgaggctctgtctggctcctccaggctggactcagcccactgctacctggctctgccctcagtggctccaccctcctttggcagtgacctgcagacgtctgagctgcatgaaagaagctggctagtgccccctccctgggtccccagatggtcactgcaggagaagcaagcttctgttcagattcctaattttggggtgggaaggggcaggctgaggcccacagggcttgttttgcgcggggataggcagcgatttggctgctggtaccaggacccagccttccttccctggtgcctctgggaagcgacgaggctggtcaggatagctggtcaggggtgcccacagggtctcctcccccgaacctctgcaccaatgacactggcacacaggccctttgtcccatgtgagcagggacggctggttgctggggggatttgacttttcattctcatggtcttcctgggaggtgggtggaggagcctattttgcaaataaggaaactgaggcccagaagagggcccctgtcttgctgaggtcttgctagcctaggtgggtagtttcctggctgtggaggcctggcgaggatgggctctgcctggctttcacgggtctgtgccccgcagtgctccaccacctgtggcctgggtgccctctggaggccggtgtgctgtagctccagccgggatgaggactgcgaccccgctggccggccccagcctgcccgccgctgccacctgtggccctgtgccacctggcactcaggcaactggagtaaggtgcatgaggatggagccaggacaggcatccccagggcatggggtggagccctggttccccacggcctgtgttccgagagcggcagggaaggggagggctccaggctgcatgtctatgtgcctgatcgcaccggattccgaatctcttgggagtcatctcatctttgtctggcttggcctgtctcctttcctctgtatctttgaccccatctggacttgttcctccctttctctgtctgtcccagcccatggcagcccctggccatgccaccttttgcctggggcctgccagccttggcctctcgctggggctcttcagggatttgcccccggctggggcgtgggtctgatgcctttcctgccacacgcctcacggggtcacgcctgtgggcctgcacgtggggatgtgtccacacaagtctctcggtccccagtgctcccacagctgtggcagaggttcctcagtgtgggacatgcagcatgtggacacatgggccctctggccactgtggcccttccattgtcagcctggacctgccaagctgcctgtgcactggccctgcggggcccagccctgcctcagctggtacatgtcttcctggagggaggtgaggcctgggcgttgagttggggggaggggacaccctcagaccctggctgtgccctgactccttccctgcccacccagtgctccgaggcctgtggcggtggtgagcagcagcgtctggtgacctgcccagagccagacctctgcgaggaggcactgagacccaacaccacccggccctgcaacacccacccctgcacacagtgggtggtggggccctggggccaggtgagccaggctgcgggggggagcagggagcaagtgcttggtagcgcctggtcagtcctgggttgggtgaaggagctgtggagtgtgtgctgtgagccaggctgtctgtggcccctgcacatgcagcagtcactggacaaagccctgccatgctggtgctcacacctgacagggagaaacagacaaggaaagggcatgtgtgctgtgatgtcagggaaggccttccgaggaggggtctggggttgagacccgagggaggagtcagtgatgccaaggacagggatcgaggggacagcaggtgtgaagtctgaggcaggaatgatgagcttggggagatcagggagcccagcaaaggccagcggcagaagggggcagaagaggggcctcgtatgggcaggacaccttctgctgggcctgtttggaactgaggggttcagaaatctcagatttgggccctgagctgggtccgggagtcagctgggccagcgtttgagtctgtccgactggctgctgagtgactctgggcaggttgctttgctttgctgggtcagttttctcatctgtaaaattgggacgctttgggagaggagggtcaggaggattaaatggaggaacgcaacaaagcacagggccgggcacagcacgacactggcacagactcagcacatgtttagggctttcagacctgcacctgttaacaacaaagcctggcgggctgggccccggctgtgaaattgtctccacccctcctgcccatgggctgcggcaggtcctctgccctgtccctcgggcacagcggtgtctcgcccacgtctctgctcactgctgcatcagggctccatcccggggcccctgcccaggcctctcagtcatgtcccgtgtgaggggctcactgccctgccgccccaagggctgtcccatggttctcatgccccttccctctgcagcagccgatcccacaagtgagagtggggttccagcaccaagtgggctctaggaatgggaacaggtcctccaggaggcactgagagggcggctgggagcaagggcaggccagtcaggcacagggcgcagggacggcttcccagaggaggtgtccctgcccccactgctagggctggccctggagacactcattcctcccctgctccccccagtgctcaggcccctgtggtggtggcatccagtggtcacacactggtcaagtgtgtcaacacccagacggggctacccgaggaagacagtgaccagtgtggccacgaggcctggccttgtgagctcccggctgtgtggcaccgaggattgtgagcccgtcgagcctccccgtgagtcccccgaccccaagctctctgctgaagtgaggtggggcgggaagggtgatggggaaattgggtcttcaaaccattgcacccacggcaccggctggctccatctgtagtctgggctcaggagccactgaaaatcctgatgccacaggatcccatgctggaggcttggctgtgctgggagtcagtcaagagaagtcccagctacacaacatcccgcaggcagctttctgacctccggtgagtagagggagtggccttggcccctgatttgctgtgtgaacctgggtaagctctttcccctctgggtctcagtattcccatagtgagaccagggatgtccctgaagctgtgtgaaaactgggcctgggtgagtccctgtcccctccccagccctagcctgtccattccctggccagaggactgcctagagtgagcaatggaaccacaggaagggcctcccttccagggtcctgctaatcccagtggtggggggtttcctggccagctgggtcctggtggaagggcctgagctagaggtggttctggatatcccaaccccccacctccaacacacacacacacacactcacacacttcctgcagccccagctgctctcagcagtgctgagggcaggaaatggggtggccctggagtgtcacctgggctcccctcaccagctgtgtggccttgggctccatttccctctcagggccttcatgtgctgaataaaggggctgccaagccccatccttgcataagtgaggtctgggcatgaagggcacagcactgcgtggggatccaggtggtgctcagggaaggcggctttttcccctcccgcaaagccactgtcatcccccattgcaaggtcagggagagggcctggggctgaccctgccagtctaaggaatccaggagctgtggcctgaagagctgcggcccctgtgctattggctgtctgccccctgaccctaggacagagtcctcagccacggccctcaaactggcattcggggccccctgcagtctccccagtctgccttctccccttatccaatgcgccttctctacctgcgctggctcctgggcagccctcatttgggctcagagtggcccctgccatgcctcgctgccatgccttgctaccctgcctctggcaggggtggccttcctgccacaaaccccattacctcaaggccaagtggcagtgcccccaccctgtcctgcctgccctcagcacgcacccagccagcatctcagagcactcctgtgtgctgcctgagctgggtgctggcatcacatctctcgccttcatggctagagctggccacagggagtggggtggttatgatcccaggggatgaggaccagatggagcagagaacaggaactgaggcccctgggggcctagaaccaaggacagatggcccaggaggctctgggcttgtaaggtctcccaggggcgggtatgagtgggctgcagggagtgggctatgggggctggttaggtggctgaactagaagctgtcctaagtgaggagttttctgccaccagtgaacagtggaggggcagctgggaaggtgtcttggactttgagacctggaattcccaggatgttttgctggtctgtgggacagttggcgggacgggggaaagccaggaaactccagagtgtgcggtcgctgcagtgacacagcatggccacatccatttgctgtggaggtggggttgacagaggagggaaccaaggcccaagaggtgaagcagcttgtctgaggtcaccccgggcgaccaggatgcaggcctgcagatgtgcactttggagctctgcctggagctggggtggaggagcctgcctgctgcctcgtgccctctgccgggcctgagggatgtccctggcacagggctggctgctgtcctcctgctcttcctccccagggaggtctgctggagtaagcagggcccaggcggcaggtgggggctgtcagcagtggcagtggcatcaggagcaaggccaggaggctggagacaagccacttcccaaaatagctctgataaccacggggcaggagggcccagccaagcctcagccctgacaaccacagcctgcagccggcctccctccccactgggcctgggcttagtccctggtttccgctgacagcctgtagggcccactcactctaggcttcgtggcccacctgagaagtgggaggctggcctgggagatgcgacctgtgactcagaacccgaggctgagtacagcccctgtggctggaggtggtcacggaggtctggcaggacagatgcactggggcagggggcggtggcgggagtcgggggcagaggccgctgcaggttggcaggaggccccgggaccgcagttctgtgccaggatctgtcggggaacaccaggggtgagcaaggatggagatgggatggcagggcgtcgccctgggcaggctctttaacaggcatgtgagggggtcagggtgcggtctcaggacctttcctccagaaacctcagcccagcagcgcccgttctcgagtcctggggtcggccgtgagtaggtgggacagagacaccaacagttggagacctgcaagtccagtttgggagccgctccagaaactggggctctctgcttggtggggagctgctggagcctccttgaggtggttggggtggggagccaggttctggataccccaaaccactggttctgatgcctctctgaccccccactccaggctgtgagcgggaccgcctgtccttcgggttctgtgagacactgcgcctactgggccgctgccagctgcccaccgtccgcacccagtgctgccgctcgtgctctccgcccagccacggctccccctcccgaggccatcagcgggtcacccgccactgacggtgccaggatgcacagaccgaccgacagacctcagtgcccaccacgggctgtggcggagctcccgccccctacgccctaatggtgctaaccccctctcactacccagcggcaggctggggagctcctccccctcgaaaaaggtatttttttattctaacagtttgtgtaacatttattatgattttacataaatgagcatctaccattctaaagcacagtgtgacttcatcttggatttggggaatcttaaaagtgagaaactcttcccccgacccctctgcccaaaactccaccgctgcagcacctcggcaggcgcggcttttcacctgctcctctggggcagatctgcagggggcagcgtagcaaacgagtccctgagagcatggcatctggtgaggcacggaaggcctcggaagccagggggctgctgcccagggaggcctgtctgcagagggtggggttctgggggcaggaaggtcttctgggcaggggcacagcttggcccttacttgctgcctgccttcagctcaggctcccagccttccctggggccccactctgtggtcctcagagacctgttccacagggattgagcccaccttgtcacttgcagggactgccccctggagtggtggggactggggcccccatgggcacctccctggctctgtctgttctatctgttgactcttctgcaaaaagcgggcagagaggggaagagcaggctggccaattttgccctactgtgtccccacgtgtcccttcatctctgtgcccagagatagggctgggctaattgccactgccttgggttggcccctttcccaccaccagcccaagcaacaggttcctaccatgctgatctatggtccagcacctggcacctgcctacccacagccccttcccctcccataaaatctagtcccatggagccagacagtagtgcccacagcagggaacagatgggcatgaaggtgctttgaagagggtcctggcctgaccaggggcgggaggctggagaaggggcggacactgtcctcccaggcccaggcccagccctggatccgaccctggcctctggctgtgagccttagactcagccgttgacaatttcctcctcagccctccccctggaaggtgttacgccccttctacaggtgggggacactaaggttcagagaggccaccctgcagcctacaggggtcacctctcacattctactctccagcgtatgacaaccctggacgaaaggcaaatgtagccctggagcctgcatgtggcagccgcagccactcagggctgggtgtatgctggggatggagaggacaccactgaaaatcactcctggctgggcgcggtggctcacacctgtaatcccagcactttgggaggctgaggtgggcggatcacctaaggtcaggagtttgaaaccagcctggccaatgtggtgaaaccccatctctactaaaaatacaaaaattagccgggtgcagtggtgggcacctgtaatcccagctacttgggaggctgaggaagaagaatcgcttgaacctgggaggcagaggttgcagtgaactgagatcacgcctttgcactccagcctaggcgacagagggaggagactgtgtctcaaagaaaagaaaagaaaagaaaaaaaattactccttagggactgagaccaagaaagagcatcagaggctgaaccccttggtgaagagcgtctgtcccaggacttggaagggagggaggggaatgtggccaggggggctgcctgcaggtgtctgtcctgctgctcctcaaatcaacatgctcacctcatttcacaccaacacgccccattctcagaggaggagcccaaggccctaagaggaagtaactggcccaaggacacatgccctagtgacacaggcccatcctaggcgccgactgcccacctccaagttccaggccactctgagcaggtgaaagagggagagggccccaagcaggccccagctatggctttgcacagagagggcagcctgccagagttcacgcaggaaagcaagttcctgggaaggctagcgtgagtcccagccccgctgtgctgaccgagggtggaggagcgtcagacgtgcttcctgtctgtctgcagcagccaggctggcccagcaagacctggggacccacgctctgagtcatgggttcccaggccttagtcagaactgcccctggtggcagtcccttccaaggggtaaggagcagggcctgtcgacttgctcctgacccacacactgaaccagtccctaggaacatcatcctgggcatgccatacctgtcgtgcagtctcagtcatgctgccagggcaggtatccagctcccagcctgggagtgctgagagccaaatccactgcaaagcagggctgatagtcagggccccacctcatctatctgtcggcaatccagtggtatctaggtgagagtcccatacacacggtcatcccacaacacactccacactccacaggccaggcggggacacacagcccccttccctccctcccaggtaccaccatagctgctagtgtgtgaccgaaggcagggtccctggcccccgctgaatcactatcgccgaccagcaggctcacacaccttggcctgttgctcctaggggtcgcctgtgctattcagccaaggggaccacagtgcctgctggcccagctgagctccgcctagcgagcccacctgcctctcctgccatggactctccctcttctgcttttcccagcaggaagggcccagcctcacctatgcaacctgcagccccacgcccgccaaccagttgaggctcccctcttagacttataagtctatggccagtggcatccagctacctgccctccctgccttccccagggtcccttcagaggaccctgggattttggaccacccagaggggcctctggcactcactccagtcatccatcccttatagcttcaccatttttggtttaagcagtgttccctttctatcaggcctggtggctgttgggtggggctccccaagcaagaggtggccctgggccgtgagttggaagacagggtgaccagagaagagagaagcccgagggggctgagcattcgtctgaactatgggtggactgcctgggtgccatgaaagaggccagcgtgtgtggggtggggagggccgccgcagtccccaggcactacctatgaagctctggcttctccctccatctccctcccctttcccttccagcccctcttttccaggaaccttgccatgcccacacctacgccctcccctccccggccctccacagctgctgcagcgcacccatactctgcacttgcctcaccagctctggcttttctctaacccgttttctctctgctttctctccaactgccagctgattgggtcaggcaagtccatcccatccggggagccccaggccccacttcgacctctaaacagattcctcctcttctcagagacctccctttccaagcctgcctgggtgggtgtcctgtgacttgacagtggctcccccagccccaaagccagcccccttcttctgtgacttagtctgttgtagtggtgagctgacacatccaggtgtgaccgttgctgaaaacttgtgccccctctgtggtatgcccctgccctgttctataaatagctataaattatcatatatatacacatacacaaactcacacacacacacacatatatatatatacacatatacatgtggtcgactgcctcgcctctagcactgggaatcagtccccgtgctgtgcttgtggagtcttgtagcccagcaagaggaagctgtctcctgacatcgcccctccaaagtgcaccacctccagtgagcttccgggacatgcgcggcctatggacagccagcccccgccatccctcccgcccttctggccaagcatggcggtgctgtgcaggcagctgtgtggcctgacagtctctaccagtcctgctgtccctcggctgagaaacccatttctgaatgacagagaatgtgtcctctgctggctgtgttctctatagagctcaggggagggaagaggccaagccatttttagggtgctgttggcagcagtgaaaaggtcacacccttttcaagggacacttttcctggaaagtccctggagcttagctggctcttattctgtgaagccggctctggccagtagggcacagggccctgaactcagcctggaaggagcctgtggggcagccggcactctggagggacagacaggccacccggtgcagacaggagagggaggcagggggacggaatggaagacacgtggggtggatggaagtcagtgcccttgggcactggtatctgtcttcctgaccacagctagatcaggcttctcaacctgttggctctcagggccggactatactccagaggcgccatggcagtcctcgtgaaatccaccaggtatcaccaggcagcatacaggtaacaggcctggaagattccccacagcccagctggacatgctgagacactctggggctcctcattgagtgggaaaaactgcaggacccagtgagggaaacaggaacatgccaggccgagcagtatggctaaatccatttattccaaaatcaaaagcgaaccaaaacaaaaacaaaaaaacaaaacaaaacaaaaaaggggtcccatcaccagggagccatgacgccatccccacccccatcatcgctcctatgctaacaatgaataagtttcccagccgcgaataattataagaacctcttcctcatatgccagctgcaacctccgctaggtacaatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggtcttgtcttgctaccctaatggtaaagggctgactggggaggggttgtagggacatggtgggggtgaagactccagacccacttctccaggcttatgctgacaggggcctgcttttatttatttttatttttatcccatgactttttttaaatcctgtaactaatttttcataactttttaaaataacttttcataaaactttttttttactttttttccacaacttttttttgccacttttccacagtatttttttatcctgtaactttttcatcccacaactttaattcctgttaacttttttagtttgtgttcttttaataaacacacttacatagttacaattttgtaagaataaaaaccgattacctcatgccaagcatgccgagaatttgcagagtctcaatacccaatactatagttttcaagacacacaaaatttttaggcaaaacagcaccttgaaacaatttaataatgtattacattacagtagcatcacagcagcagtcaataatgccactttagacaaaaatcagtatttccattatgcattctgtgtataagaattcataaatcggtaaaagtcattctaagaaaacttggcaaatacagctttggactggaattggcatttctttgtctacttttccttcccctagattctttgttttaaactacagtattcatattttaaaatgttttaaattattttaagacgttaatatagcagttacatttttgaatagttatttgaaagtgactgtaagataaagttttagagaatctattatggatagggttgatttacattttcacattttctaaaaatcagctttggttttagaactgattgtttttcattttgggaaaacctaccaggtttaatcaattactttaaaaataattatcatattttgcagtctttaaataggtgttttgattctttactccctacagaaattcaaatttattcagttgaagtcacattttaaaattctatgttcctgctgaactctaaccttctaatgttgccttctaagcaaattaaaggctgccttatactgaatgaggtagagaacaaatacttggctgaatgaggtactgcaaaagactgcatgcactttgaagaaagacttgagttattgtcataggatttccattctctttagctttttcttaaacatatgacaaaatacctacacaaagagtcgtatttgaattaatatagtatatttatttttcagactgacattcatcttaaatatgccagtatgtgatttaatccacaggtacctgatgaacacattattgtcagattggttacagttgctaaacgctatctgaaggtcattcctagtcatttatacgtgtcagggtaaaagtgaagcgatttgaactataaaaatacctttgaaataatttatcaatgtattagataagctcagtttcagaatgataaacaaaaactgttagaccaaataacttggctaattaacagtggtacgatttctagcccgagggtttaaaatggagttaaagtaagtgtctttaaactgaactcaaagaatgcaaaagcggcaagttcagacaaggcaagaacaggacctttagtccattttaagccataaatattacacaaaatatgcctctaactgaaactgagaggtataaaaacatatttcactcttcgtaaagaactttgtgaggaaatataactctgtgattgtatagacactttcctcatgacactttgacagtcacaaacagtagattgcgctgcagtttgtaaacattttacgttgcataaactgctccttgattttcaaatgtagtataatactgtctactaaaactcctttttgtttcaactaagtactctcacatatattagtttataataatgtttgttattatttttaaagtgttctccattcaaggaaaagaagtaaattcctatgtcagatggttgaagactagctattagccagagaggtctagatggtaaaatccatcttctagcctcaaataagctccatgaacacagaggaatgccaggtgtcacacagctttccttcactcgaattcattcttgactagagcctgtatatgcctgttccaggggcatttaaactcttaaaggatttcttctgatctttactaaatacattaaggagaacgccaaccagtgcccttttgtgtactgggacatgtagtcatgtgattaaaacagggaacatgaactctgactttaaaatgtattgtagatataaatgctctcagctagaaaaggttttccacatccacagtcatgatgggagcctttcattcctcagaaataatcccttttcaggtcatcaaaaaagagtacaactgccacagctcatgaggcagtatcttcatgagcccagagcacatacaaatcctaagggaactaccgtagtacagcgctcattcttggcaccggaacaaatgaaacatattctatcctgcacacacctgccaaagcaggccactttcctcttctgggagatttaaaaacctccccaaaatgttattactcccatccccaatacacagaaaaagggggaaaggctgtttccagtgctccacctttaaacaactgtaaatgtcagtactcacagtggcatattacaaagtaatagaccgcgcacttgagggcaaaccacatattgagctaatgaagagctcactgtgattaggattcgatcaaacataacagcagaacataaggaaattttatctgaattccgtaatgaatatacaggctgtactaacattaaaaaagcatggcagcctatcccaaaccagcaagaacagttgtgtgcatacagtgggtctttgtgtgtttgaactcccaccacataagggcaaactcgatatgcatgctaacgtcctataattatcaaattaaaaaaatgctaaaagatgccagagtgaacatgagagaaagacccactctcatttaactttttacaaataaatttaaattataaattagaaacacaaataaatttaaactataaattagaaacacaaataaatttaaattataaattagaaacacaaatttaaactataaattagaaacacaaataaacataagtggctctaacattcaaatgaagtaaatgaattgtgtaggatattaaccccttaaatgttttgttttttttttttttcaatttcttgacccgctcttagatgatggtgatgtttagctccctgttctccgcagcccgaaaagaatggcatgcagcctcttctgctcctcctgccgcctctcctgtaccaacagcttctccactcaagcctgggtgctcctggggagtcctgcattagaggaagcagctgctggatctgctgtgcagtggggttgtcatgggggagaaccctccctgtcctctcccggtgcagcctccatgctatcagtgaggctcagctcactaagatcttcagagagagggagggggtgggaatctgggcacagtgcgagcctcccctgctcctgcctgcccaccccgcctgagggctctactcaccaccctgcttgtccgcacatccaagctccttgtgggactggggctccaggtactggtctggctgctgctgcagactcggagcctcttggctcttcagctccacctgccggaagaccctgggcatgaggacatgtggtggctggcttccagattcctggcccattaatagggtagcgagggcactgtggggctctgtggcctgcccaggcccctggccccttgctccaggcctaagagactgtctcccttgcctagaaccccatgcctccttccctagcatcaaatctcacgtcctttttcccagcatgtaaactgtaggccacagactggtggaaaagcaggcggagccaaccaccatctgctaagtgtgctacatgcctaatgtttccacgtattatctcatttaatcctcagcacctctgcaaggaaaaggctaacttccttttgaagttaaagaaacagagacttagagatgcaaagtagttgaattatgaccagtggaaccgaggccggaatccagtttgaatctaaggagtcttttttgtttttctgttttgttttgttttgagagagtgtcactctgtgtcccaggctgcagtgcagtggtgcaatctcagctcactgcaaccttcatctcccgggctcaagtgattctcgtgtctcagcctcctgagtagctgggattacaggcatgcaccaccaggcccggctaattattattattatttttaattttagtagagatgagctttcaccatgttggccatgttggtctcaaactcctgacctcaagtgattgtcctgcctcagcctcccaaagtgctgggattgcaggcgtgagccaccacacccgacataaggagcctcttataccactgtctcttcctctgtgattggggggctccatgcctctagctgggatgatgatgatgtccagacctgggagggccccagggctacccacctctaaaagtcagagggcaggaagcaagaaacagtcataggactgccccggagggtgctggggtcacctgtccccaggctgcagctgcctgtggcctggcacctcccctccccagaggctggtgcccgcctcccacatcttcttggatgggtcagaggttacagtctctttcagctcacccgacttctccagctcctttacttgctgctccaactgcagtgtgctcttgttctcgttgttctggacagagagaagcaatcagtggccacccactaaaactggagaccccagaacttagtgtctgcctcccatggcaccgggaagggtggaggcaggttagaaaaatatcccctctctcccacagccatcagagcggggctctggctcacagatgcctttagaagtaccatttcatgtgaaggctacaatgccccattttacaggtggggaaacaaaggccttgagggctagggaagagggcagcctccccaggtggggcaacgtaccagctcctcgaagccgctgcgtggctcggcccgctgctcgtacagggcttcccaccccagctccagcatcctctccagctcccgcagcctctccagctcccgcagcctctccagctcccgcagagtctcctgctgccacagcctctcatcctgttgccgaagcctctcctgctccaggagctcctccacctcgtccagcagcctctccctctccagcagcctctcctgctcctcctgccgcctctcctgttctaacagcttctccacctcttccagcagcctctcctgccctggcagcttctcctgttcacacagcctctcctcctgttcacatagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcatgtagcctctcctcctgttcatgtagcctctcctcctgttcacgtagcctctcctcctgttcacgtagcctctcctcctgttcacgtagcctctcctcctgttcacacagcctctcctcctgttcacgtagcctctcctcctgttcacacagcctctcctcctgttcatgtagcctctcctcctgttcatgtagcctctcctcctgttcacgtagcctctcctcctgtctcctgttcaggagactcaacatctgattgttttccacctcagcctggagctgtcttcccacactctctagctccttccttaggtggttggtctcatcttgtagctgctccaccttagatggccctgctgggggctctggggccaggggttcagctgagaaagcaagcagagaataagggcctctggattctcaaaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccgagactcacatccccaggtgagtggtaaccaccagaagtggctgtgtcagggctactgccattgactttctttttcctgttagctcctgctggaatgccagggctcttcctctgccaatatgcttttaactgtgggaaagaagagcagtaacactcatgagaatgatcagcccctacagccacatcctcctttacagttttgacaaaatacccttatataccatctgatgtaatgccaccaacaaccgtacaaggtgttgtcacaatcagtgactgagagggattcatatcatggatagaaaaaaaaaaaaaagaaagatcaaaaaaggcaatactggaacttaaactcagtcctctgactccacgctctggggttttgccatgaatcagcagcttccagggaccaaaaccaggggcagaggtagaaaagcacacattaagcaggcaggaactgtaggccgtgtggtttagagtcatacatcctcacaggtctgctagcgtgaagaagcgtaccagtacctctcacactttcatatcaatgtgtcctcatggcagaaggcagcttttctattaaatctgggaatttatcagaaagaggacaacccaagcctcatttcagagcaaagtctggtatacgcttggaaacctatgtgtctgtcacccccaagtacattaatgcattttctcaagagaatcaagggaaaatgatgcttcagaaagatgtcccgcatttatcctgtggcactcaaagtaccccaggttgagacgatatgaggaagattcaagctgtcaagttcagtttcccaagatctattccacagaagatgagcaaatctcacttcagaggccactgactgaagggcagtctggtcccagaaccgtggagaactcagaaaaaaatgttaaagtctctctggaaagtagaagcctgggaaaaaaccaaaccaaacccattctcccattgccacccagagatactgtgaacattttgagctcacaggggaagtgtaggcttttcccactgtcaatgtctatgttaagggagtaaggcagcctgaaacctcttgctcctaggtcccatagtctccactccccttccagctggaaatttgtgctgcaaccagaggaaccagaaatggggtgagaaaacttaggggactgggttgtaagatcaaaggctggtcttgcagcagtaatgacagttcctaggggcactgtgacatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgttgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaacttacagttagtatatgagagcagttctcaaaaatgtagtctctggactagcagctccagcagcacctgggaacttcttataaatacacatcctccggccccaccctggacctgatgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagattttgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtaagcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattgacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaagcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaagacggaacgactgtggtgatcgagtagccaaaagttcacggaatgcactgtcacaattgtgattccgccatagcgccgtgcatccatccaacacttgtttaatacctatatttaatacctaataccttagagtgtcctaggctgtggacacacaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgctccgcgtgtactcacgggaggactcgcagacgttactgccttcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcgggatgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacatttttttttttttttttgcaaaggcaaaccggtatgtgaagttgaaaaaatcaaaaaccctcaaattttccttcttttttttttttttttttttaaatcaagaaagggggtagataggtttgttttgttttagaaatagtttttatagcagagtgataccgtcacatttaatgatcctactgtgaattcaagaattcacgatgaaagttggattgagcggtattttggtgttcattctttgctgatactcattaatgaagttcgttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggatttctaaccttttttttaatctgtcggttattttttgaaaagaagtggggcttaactagtgctctaaggattttaacaagagattccgatttagaaatctgtccccccttttggtgaaattcttattttttttagagtcagaatcttcactgttgcccagttgtctccccgggacccaagccgtcttcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcatttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctccgacttgtttaaggtagaactggactgggtgttaacagtgttagttcagtagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacacggacacagggaggggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagtaaacctttgaacttaacagattgagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaattttttatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcactgccatgcctggctaatttttttatttttgtagagacagggtctctctatgttgcccagcctggtctcaaactcccgggatgaagcaatcctcccaccatggtctcccaaagtgtagggcttacaggcgtgagagcctgctggggtttttgattgacattgcattgaaactggaaatcagttaggaggcaactgacattttaataatgagccatgaacatggtatatctatttatttagaccttcttagatttttcgtcagtgttttgtagtttttagcagttggatcttgcttgtattttgtaatcttacacatttatttcatgtttgtggtactgttgtgaatgatacttctcaatttccagttggtgattgctagtatataggaaggtgattttatgttatatgctgaccttggattctacaaccttgctaaactcatttttagtactagaagcttttttgtagatttttggaattttgtgcatagacagtaatgtcactggcaaataagggcagtttaatttctttgttttcactttgtatgcttttatttccttttttttttttgagacggagtttctctcttgttgcccagtaaattagcccatgtaaatatttctgtttgtatctcttgaaagtaaagactcttttaaccatggatgagtgtcttgatcaaatcaacatggcttgttcatgtcgataccatttgctcagaggggaaagattaagggaaaaatggggttggatttcaaatgccaggacctgtctactgggtttgtgatttgttattctctaaagttgtagctcttaaaacaaagaaaggagtgagtttggcctattcattaacttttactctttagacagttcaaatgtttattgagttcttctacaggccgagccctgccttcttcatgcttaccaagaagcatttttacgcggtttctctaatgtttgggtggacggtacctcactaagttgtttttcacgcacgtgcgtgctcgttcctgaagagtcctgtccaggtgccctgcccgcttttcctttcaggcttctgtatcagctgccgtttccctatagaacgtgccctgacctccaccccttaaccctaaccaatttgcctttacatgtctgaccatccatcaaggctcttttgggtcatattcagtccatgttgatatttccccttcctcccttctttagtccttactatttttgctttggtcatgttttcttacactgtattctgtaagcctgtttaatttttttatggtggcaggggaaaatatttcataattatgctttgtgctttttatcttccactcaataaatgcttggtaaatatttgttttattgaatgtatgagcctattctagctatattgtgcttgaacaaaaatcttaactgccttgtaagttaactgctaagaatttgtcaaaagtgcagagataacatcaagagcttgtcatggatagtacaaaaaggtctctaagggcttgatggaagtctgtaaattgacttcctatgaaagagagtgtaagaagtgaaaaaaagcaaaacagagtagatgttttactctgtttgccaagggatttgtgctatttttttcctgttttataaatttgccctaatcttaaataatgaagggaaaagagcactctttttcaaccaaggaatcctttttatacttcttttctgtgaagccatgttatgaaagattgttatacaaacttaagtatagtttttccatcttcagtaacagacctgattgccatctagttactggttctgatcacacaagaatgcaaagcagcttgttctaataacttgtgcaggcctattgggaactagtatatggctttgagtccttttgaagtatttaacataatttggcaattccattactccttttatggacttcttggcatctatgaactcttggtagggaatcactgttttagaatgaaaaatgtctcccaggaagtaaattagccggtaaacaaatgaaacttcattttttatatgacttgtagagcataaattattactctttctgcataagtggctgctttctaggctgcttttagcgagattgttagaaacaaatgatcggtgctgtgaggaagaagcagcactcaggcaaaaaagttttctcagcaagacaatttgcttctgcaagtatgctgcttgcattagtcatgattgcaagagcacaccaaacggggtggagcaggggttcttatccctaatgcactccctacctctgtgtcattccaacatgggctggggtaggactgcacaatcttagctgactcagctggatattgtgaatattttctctaataagaaagggagggggaatgtgagttacaggttgggactggtaggaagagttgtttacaaggcaggttactaagcaggtaactaagctggtaagtagggtcgagaaggtacagggaaattgttcttaggaacaaagaacaaggaagttgaacaagttaaacctttgaagaggaacttactgtacctaacaattcccccctcttaatttttgtaattcttcctcttcaaacttttttagcatgtctttgctttgctgttctgcttggttttctagaaggaaaagcttatctgaatagggtggaggagagctaagagaagttttggtaaattctgtgtctatgagtctttgcagtagtccacaaatgtatggtatgatacagcatccaacaagaataagcacacctataacgattgcaagagaagtaaatattgaggacattaagcctttccattttccagaccatttctccattaaacttgtaaagggatcatttattccagaattgcttgctaactcattggataaggaggttaggtcctgcaaagcttttgttactgttccgtcaggggctgtgttattaggaataaaagtacatcattggactccaatcaagacacagacaccacctttttctgctagcatcgtatctagggctatcctgttttcccagactatttagttaatgggacctaattgggaggctgttcccttaatggcatgtcttgtgtagttaacaaacctttgttggttgtaataaatgtagtttatccaatctacatttttatttacagttgaccaccaaaacagcacagattcaaatcctgaagctgtttgatttcgggccttaaatttatctggtacccctcgtggaactccagtagcatctttataaacgtgggagtcaaaggacccatgaaggtcacttcttctcttctgattttctcttctattatgttaatggaatgctagggtgaaagggatggccagttggactagagcacaagtaccactccagttacttggcagagtgtccagtaagggtccaccacaataccaccatacgtatgctcgaggatgaacaagggcagactgactggtaagctcttgggagagtttaagttcaccgcatccctttaggtcttcatgaaatgccaagttttccccttgttgtgagagacccgaggtaaaaattggtgtcaatagatggaggctggatggccctcagggactgacctgcagggtgttggactttagggaatagcagagagagagcttggcaagattcattaccccaggctgtggggtcttggagaagagctaccatacagctcatgcccagttggctggaagaccatccgagtggaaaggggacaacctgggcctctggcctactgtgcgcacaagtgtaacagttgcttttgtttagagtgcggacagaatatttaatccattctaaccaagcatttgcatcttggtaccctgtctcagttgctatggtttgtttcaaatttttaacttctacaatggcttaccttgattttatccttggttgaaggaagaacagcggtttcgttgagagagagtgtagaaggaggtggaggaggtgagaaagtaatgaaatgcatttcaaaggattctataagatgtgtccctgctattttggctcctatgccgtataagcgacttaaagtaggtttagggttggcagaagtggggataagaatagaaatttgcactggattacattggttatactggcagtcagggggtggggaatgtttcctttaacaaagcaaacatggttttagagacttacaactgcctgttgacaaagccctgatgttcagttgtccacataatatcattccagctgtggcaggcctgtttccctacatttcttaaggaacaagagtcgtaatgggggaggcttttgtctgaaagggacggagatacttctctgaggctgagagttgcttttgactttggagatctccacaggatataacaaggcaagcatcaaaggtaatagtttggggtgagctcgacctagttacattaataacgagaggactagcaatagaaggggaaaagaaatatagcataagaggatcaaacccgttttagctttaacttggttggaattggccctgaaatagctgtccatgattctggagtgggtggtgctcttttgactcaggtatggtgagtccattctttttcagtggtgtggacggctgtctcagtcattagaaacactagataatgtccctcccaggtgggcttgagcttcctttctttctgacctttgatgagaatgtggtcactgtccgggctggtggtggtgaactggaaattcaaggggtggtgtatgtgccaagaggcctttagtcctaaggaaagagaaagtggaggatagaccaagtatatagttcttgagaaacagatcttttgtttcgaacgaggaatgtcagcagtggagtgtagataaggcaactcatacagcatttcataaggaggtgagccgacatctttcctaggggcagtttggaatcttcacaagaccatggggaggcatttagtccatggcaaccgagtctctaggactaatttggttaggtggtttttcagagtctgattcattctttctactcttcctgatgaaggtgggtgccaggggttatggtagtcccatgttatatctagtacttgggctagtttcttaagaacatgtgcagtgaaatgagtcctattgtctgaatcagcattttctattaatccaaacctgggtataatattttcaactaatgccttgagtacattactagcagttgcacttgaaaagggaatagcttctacccaatgagtaaggtgatctatcactaataaatattttaagtgaccaattgggggcatttcagcataatcaatttggacactttggaacagccttaatcctggatttctccctccaacaggtggttttctgaggatctgcttattagtcttcttacatactaggcaactatctgtaacttgtcttgccaaaatataaattcctatacatctgtagaccccgaggactgcatcacacttagcttgaggtccctaatgagtcccttgatgcagatgggagagaatttccctcatgaggggtttggataacatttctctttggtctggtgacacccatttcccttctgaattttctttggctcctatttttattaatttttccttttcagcgggagaaaagatggggactgcagtcgagggaggaaggcaagggactaagtgaaaaacaggcattttcagaggaaacggcagtgtgtttggctatttgatctgctaggttattccttccgctttgaaaagaaagacttttctgatgtcctggaacatggacaatagctattctggcagctgcaggttatctaatacttgggtgattaattctttgtggcccaggtcttggcctttgctattaataagatctcgttcagtccaaatttttccaaaggtgtgagctaccccaaaggcatacttggaatcagtataaatagtccgttcttggttttgcaagtgctttaaggcttgatttaatgcaaacaattcattcacatgtttgggcagaccaattatttggcaggcttcctgactctacttcttcaagtgcctccccatctactactgagtacctattacgcctttttccttcaattacttgggaagagccatctataaagaagccctgccccgttttgtaaggggtctctcttaaatcaggcctaacttttgtatgatcattaaatctaaacactcatgctcaggtctctttagatttggatctccagtcaggaaacctctgggttaagtgaattatcagtggttagtgttaaatcatctctttctaacaggatagcttcatactttaaaattctcaagtcagtaagccaccttcctgccttttaatttaagatggctctaacctgatggggcatgtttacaactaactttcccccaaaggttagttttctgctttctttagttaacaaggcggtagctgcaatggattgaaacattcaggccatccacaggttactggatctaaaacttttgataggagatccatgggttgctggtgacctccgtgttcttgggtaaggacccctaaagctacccccttatttatgttaacagaaaggtgaaatggcttttctagggaaggcaaagctaaaacagaggcagttataagcagatgttttagctcctcaacctggtggagttcttcagaagtccagaggagagggtcaggcttttcttgggtgatttttaggtagagaggctttatgacaagggcatatgagtcaatccataagcggcaatatccggctatccctaggaattttctgagttcttgtttagtcttaagcaaaggtatggatacaatcctttcaaccctctcaggccctatccttcgtttgccgttacttattaagtgtcctaggtatttaacttcaggctctatgaatcgaagctttctctttgaaacccatagcccctctccttacaaatggttaaggatatggacggagaaagcagataccttttctatagcctaaccggatattaataagtcatctacgtactggagcagacatatacattttggggtataaacttgttctaacacttgttctagaatttgaccaaagagattaggggaatctgtgaagccctggggtagaactgtctatcgatactgttgctgtcatccagaatggggatcttcccattcgaaagcaaaaatgtctcagctgtcctcatccaaggagcatgctcaaaaggcatcttttaaacctattactgtaaaccattgatgttcatatggaattttactgagaatggtttaaggattagggacaacaggatgggtagtctagactgtctggttgatggcccagaggtcttatgctagtcgacatgacctatctggtttcttcacaggcagtattggggtgttataaggggacatacagggttcaaggagcccatccttgatgaggctttcaattacaggtttcaggcctattctgccttctaaaggaatagaatattgctttcttcttactatttctccaggggtttttaactttatatgtatagggggaatttggagttttccccaatttccttcccttgcccaaacatcaggatgaatgtatgtttcttctgcagtggtgagcaggtttaatgaagtgtagaatccttctgagccaatacgtaaacctatacctaattttaacattaagtttcttcctaatagattagttcctgcctctgaaattaacaaaaattcaacattagctgagcagtttttacatctaatttctgtttcttttaaaatttttagtttgattccctctccttttacccctgagactacaagctcctctgaggaccaggttatattgtgggggaaggtaacaaacagaggagcaggctgctcctgagtctactaaaaaggtcataagctcggatttgggttccacttctaaatttatcaagggctcttggtgggattcaaggtaaaagagacagagcccctaacccccctattcctcctcaaaggtcgtaagtgggacgacttctctttctgattttaatttgggacaatacctcttgaagtggcctactttctcacaattgaagcattgattctgtctcttctctctatttttgggtttctcggctttgtctccttatgttctttatatggcttaggaagtgggggcctaggatctttataggttttggctctcgggaggctttgtttgggagtgtgtgggtctctgggtaacagagagtaatactggtgtgttttatcctttggggccccctgttggaaggtggataacataattttcattttttctttttgcttctcctcatccctccttacacacactttctgagcttctctaagaagctcgttcgtgggatggtccttccaatttcctatcttttgtaatttccttgtgatatctggctgttagtaacaaaatgaagctttaacattcactgcctaagaggatcttctaaatctaggccagcatattttctcatttgttctttcaacctgtctaaaagttcgataggcccttcatctttcctttgttgtatgtcgaatgctcgagtaagattttgggttcggagtactgactcccgaatcccttttattatcatttccctaagttcttgcgtatcctcttcagtgggctgcgttattattgtcccagcaggggtcttggttggggaatttttgatccgctgcatgaatgttttggccaggagggtgttcatgttcccagggtaccatagcagctctacagatgatgcttctttcttcccctgagaaaaggatgcctaggatggacattaactcagcccaagtatatataactgtggtcctagaaattggttaattcgatctgctattccactggagttgtctaatagtgtggcttgaactctgtttttaggttttggacctccgagctggttaaaggagcatttacaaagtgaatacctcctcctcgtagggacacctctcttcaggggaagagaggtggagctaattctcccgaggtagaggggaaggggaagttctgaatatcccttttacattgctctatctcacactgaagtcctttcagggaagagtacttagggtgatagtgagcaggctgttgggacaattcccaagaggcagggttataaagagggggaacaatgtgggtaggagaagggtctgggacaactgcctctgcttgagggggaaggaggttagggatattggacgggggaaggtggtggaggaagttccatgtgttggtgagctgtctaggaacagggaccttatctttctcagaggagttaatttctgacttgcttttcaggattgattcctgagtccaaatgaaacaacaatattttatcatttgctgctttttcttgtatttagtcctttcactctcttttcaatattttagcataagccctaggggactatcaggaggaatgttattgttgctagctttatcctttttctcccctgcattacttgaggtatttcccatcttgaaaagggattggggtgaggctcaatttcccctactagaaatttcttcccagttacgagaggtttgtataaggctcaacctctcctactggagatttctcacctttcctttccttcccttcccttcccttcccttcccttcccttccctttcccttctctttcccttccctttcccttccctttccctttcctttcctttccctttcctttcctttccctttcctttcctttccctttcctttcctttccctttccctttccctttcctttccctttcctttccgaggctcaacccccctgctggaggtttcttgcacttttctcctttcgcttcatccttctctggctgcttccctcatgggaacgttggtttcctcttagcaatggctgtttcagtagaaacccctgacccagactcctttacagaagggctaccttaagctgtataaggtgaccacagaactgcagatctggactgaacacttgctttgcactcaattgtgagtctcaacacacactttcaatctccaagatatcccaaccaccaagaaaatagtttgtcgctcttgtgatgtttcttacgttggtctgtgcacatagttacctggtcaccatggtatgtgaggatccttttctcttaagttgttggtctgttcctttccagactgctgagagtccgggtttattcatcacactgggtgggtcctgatccctcaccatgaggccacctcagtgaggcagtgggatgcttctcctcactattggtgactggagacccttttctcagaggagaatgggaattccagacgagcccccagattgttagaaacaaatgatcaggctgggcacagtggctcgcccctgtaatcccagcactttgggaggccgaggtgggcggatcatgaagtcaggagatcgagaccatcctggctaacatggtgaaatgccgtctctactaaaaaaaaaaaaaaaacacaaaaaaattagctgggcgcaatggtgggtgcctgtagtcccagctactcaggaggctgaggcaggagaatggcgtgaacctgggaggtggagcttgcagtgagctgagatcaagccactgtgctccaccctgggcaacagagcgaaactctgtctcaaaaaaaaaaaaaagaaagaaaaaagaaacaaatgatcagtgctgcaaggaagaaccagcactcaggaaaaaaagttttctcagcaagacaacttacttctgcaaaagactgctgtttgcattagtcacgaatgcaagagcacaccgagcaggatagagcaggagtttatatccctaacgcagtccctacctctctgtcatttccacatgggctggagtcggactacacaatctaagcagacttgatttgctatcgcgaatattctccctaataaggaagggagagggaatgtgagttacaggttgggactgacgggaagagttgtttacaaggcaggtaactgagcagataactaagcaggtaaataggggtgagaaggtacagggaaattgttcttaggaacaaagaacgaggaagttgaacaggttaaacctttgaagaggaacttactgtacctaataagtttttttgattggctaattaaatgtctattcattattgccaaaaagtgcctacctcaacaacaagataccaaattttagaaaatgttggagctctctctgaatctaggaggaagtgagtagtttagcttttatttagtagttaggaccttaagtaaatcactttttttactgtgtttctgtataacatagataatattttttgccctgcaagagagcatatagaggaaagctctttggcagcgatactgtgccctatgaataaaaaagtgatggtgtcatttgtggctgaataacagtttattttgagaatgctttataacagcttttcatgggaaataaagcaatgctgttaacttcatcttgcatttttctcatttttactatgattaaaaagtagtcagcttgtacaaaggaaagaaacaagccttgactcaggagcctaggactttttctttggtttgccctcctggaacagattacctttccaaattgaatttgtggaggagcattgggaaatatcagaaatgtcatattaagcacctcagtggtacttttaatagaggagttattcagaaattatactaggcagatagagagggtaaggaggcctcagtaaggctttcccttttaatagaaacaactccagaaacatttctttttcttttctttttatcttttttttggagacggaatctcgctctgtcacccaggctggagtgcagtggtgtgatctcagctcactgcagcctctgcctcccaggttcaagtgaatctcctgcctcagcctcctgagtagctgggactacaggctgccaagctttgatatgcaaatgccagcgcttagaaactgtgtccattcaacatggagattcccaccctcttcttctagtcaccacctcaaggtgacacctccagatgaccccatgtgtgcaggacaacatggtgacctacatttgcatattaaaaggctagggtgggagggccacgtttttctcgggctacatgaatgacctgcctggtcaaaccaatgccctgggccctgtgcaaatcagacaccacctcctccagcctcccaatataaccgagtactgttctgccacacacggggctttttctctgttcagacccccctttttctgtaccgcagggagcctttcttctttcttgcctattaaactttctgttccttaaaaccactcctgtgtgtccatgtcgtttaactggcgtgagacaaaggaccccgatgtttctcccgttttcagagccatatcactttgagtccagaggaattattttcatttatctgaccaatttataatatagggtcaaattcctagtggttatcctccctcatccccatttttatacccttccttgaaaggaacaggtatatgaagaggagacaggtttcccttttgtgaatagtatatcccttagtatcttgatttttttttggtgggggtggggggagttaaacttacttagacctggtaaagggcagtatttgataaatgtcagctagtttagggttagggaattgagttgaatggagatagtcactgccaaatgtaaagcatgactggagagccacagtgatgaagccagggtccctttctccagatcctttgtaacagtgttatgtgatctcttctagaagattgttctgaaagataatgccaactcggaacctaggaaaccatccagtgggtttctgcagcttaggtggttcaaatcctcatcagcacgtttgttttctctgcctcagtttgcttacagtgatgttctcagtagctgtaattgctgtctttgaatacttaagcattttttttttagctcacaggggtatgtgtgcatttttcttttaccaagtgttagaactttgactctgcttttgtgggctctggtttagcaacttggttgtttagttgtaaaatgattagtagggaaaaccgtgtgtgtgtgtgtgtgtgtgtgtgtgtgtgtgtgtgtgtgtattttaagtttcttttgttctcagagcacttagaattttatatggaaattctatcagtttacttgattctccaccccacatttcttaaacagcaaagtatgaaggtaatgtgtcccgtaaccagccttcagaataattacagctgctgtgtctctgaactttcaagaagtttgtgcatcaattttcaaaaaattatgaaatccttgaagatagctgtgttctacatttggaaagatacaaaaactgaaccttctagcaggcagttttgcttgctggtgcttgcgatagagccacacattggtctcagtggatttatggagaaaaataggtacggaaagttatttctaaataagaccaaaaatccttttcttaagcagtgacaggtaaagaggttgtcttggctaatattgaattgtgttgcccttgattgagacagttttatggtggggatggtagtggtgataaacttgtttgaaatttgtccacctatagtaacctttgtggtagctgtcacagacagcttcatcctcacaggccctaaaattactataaaactaatagattggaggagaaacaaaggacctgaataattagatgcttagataattgttctgtgttttcataacaagtgaaaaagagcagtgttagaagtacttaaactttccatgtaaggagcactgcctgaatttatattgtgattttagagcatcattcactgtttaaaaacaggcatattgtgggtcatattttaaagacaaacagaaagcttatcttttcaagatggatctaaagcttaaccttatcaaaattacaaaatgtgaaggatatgattgaaaaatattaatgcataggtttaaatattggtcatcattttagatgtctttcaaaataggttgtctcttaaatattaaactgaacaaacattgaacttgttgtagagtttgtgctcaaggttaagtttcctggggtgatggatatttgataatatggataacaaaaagttcttaagaaatttagaaaatttttaggcaaaactagaaaataatactgataattctaccactcagaatgtaccactatcagaattttgtatctttcagtcatctgctcatctcttttctcctttgcttgtatgtgttccctctcccttaaaaaatcagattttttttttgtaatctgcattttcactcaatattgtagatctgtgtcataagttactcctctacagtgccttcagttattgtgtgctttgtgttggatgactgtaccatctagtctttcgtgtttcctggtactgactacataggggtgagtgtgtgtgtgtgtgtgtgtgtgtgtgtgtgtgtattttttttctaccttaactaatgctttggacatcatcaacaggtagagctaaatccttgaaaccttccaagtggtggctttcagttattgctgaattggtttttagagatggaacaaattatattgtatggaaacttttttttttttttttttttttgagacaaagtctcagcttgtcacccaggctggagggcaatggcatgatcttggctcactaaaacctccacctcccaggttcaagtgatcctcttgcctcagcctcccgagtagttgggattacaggggcctgccaccatgcccggctaatgtttgtgtttttactagagatggggtttcatcatgttggccaggcttgtctcgaactcctgacctcaggtgatccactcaccttggtctcccaaagtactgggattacaggcatgagccaccatacccagcctttttttcttctaggtaccagcttttatttatcagattggtataaatgttagaaagcgtgcaatgaaatgggcattttcacagtcgtggcagaaagtataattatctttgactttctagaaagcagtctggcattctagaaacttgcctaacctcttcccatttagacaagatgaattctgacagggccagccttgtccctgtgattccgtatctcccagaaagagaggtctagtctcagggaaaacccagattttcttggcttagcccacctgacagctaatcactggaaatggggcgggccggtagagtcctttggtcaggttttgtgtcaagagagggatgtggaaagatgggagagaggtagcaaaactggcctcaatggaactgtgtaagttaacatagaatggcaaaggaatgtttcttccaaggaagaaattctagggaaggaataaagtagaggggaaggcagcagttctcaaagttttggggtcaggattcctttacactcttaaaagtatattgagggcccaaggagcttttgtgtatgtgggttatatctattggtatttatcactagaaattaaatcagaaatacttaaaatattccttaaaagctcacaaaatattgttataaatgcttttatgataagaaaatttctaaacccaaggtagtacagtcttacatcttttgcaaatttctttgatgtttgatatgtcatttgtacctgcattcaatttattgtgtgatatttgcttgaaaaaatgtgaacaaaggacagtctcatacagataggcatttcagatcattgtggatatttcttttttctttctttctttcttttttttttttttttgagatggggtctttctctgtctcccaggctggaatgcagtgctatgatcacggctcactggagcctcattctctggggactcaggtgatcctcccacctcagcctctagagtagctgggactacaggtgtgtactaccccaccttgctaattttttgtattttttgtagagatagggttttgccataggtattcaaatagaaagttttgtttttgttttagtatataaagaaatataactttccatgttggaaaaatttttaaaacctttttttaattttaaaactcataagcaaccattgttgagaaaattggtaaagtacagaaaagataaaagaaaaaaattaaagtctcccataatttctctatctaatataaccactattgactgttgacatgatggtcattttctaccagtatatattttttctttgctattaaaatacataacccttacacatatgcttaatagttgaggtcatattctctatagttttatatatatatatatatatatattttttttttttttttttttttttttttgagacagagtcttgctctgtcacccaggctggagtgcagtgccgtggtctcggctcactgcaagctccacctcctgggttcccaccattctcctgcctcagcctccccagtagctgggactacaggcgcccgccaccattcccggctaattttttgtattttttagtagagatggggttccaccgtgttagccaggatggtctcgatctcctgacctcatggtctgcccaccttggcctcccaaagtgctgggattacaggcgtgagccactgtgcctggcccttttatattcttttaaaaagtatttactgtattttcctgtgatgtcatagtctttatagaaaaataatcattattttcagttgacatgattgtttacctaaaaatatccaaaggaaccaactgagaaaaaacaatttttaagattactggttaaaagttcttttatataaaaatcaatagccttccccaatgttagctataatcacatagaagatatagtgatgaagtattttttcaggtatttcagcaaaaattaaatgcctaggaataaacttagatgtgcaggacttttatcaaggacaggacaaaattttgctgagtggaatgaaagatttgcattctatgttcctggatgagcagatttcatgttataaatatgttagttatcaccatgtcttcatattaatttgtaaatgtaatttctgctgggcacagtggctcatacctgtaatccaaacagtttgggaagctgaggcgggtagatgacaattagctgggtgtctgtggcacacacttgtatttccaactacttctgaggctgaggtgggaggagcacttgagcctgggaggcagaggttgcagtgagccgagatcatgcctctgaactccagcctaggtgacagagtgagaccctgtctcaaaaaaaaaaaaaaaaaaaaaaactagaaaagtgtgtgtgtatatatatatatttcatattttataaatatttatatatataaattgtatatatacattttatattttatatatagtgtgtgtgtattatatatatatacacacacacacaaatttcagtacaaattctggcagatttatttttgacacttgacaaaacgactctaaaatttgtttagaagaataagtaataaaaattaataaagtatagactctttcaaccagatagtaaataaaatattgtggactatccctgggccagacagataaaggcaatggaagtttagaaccagagtcatgcaaacgagaatttagtataaggaaaaggtggtattttaacttaatactgaaaagatagattattctgtaaatggttttaggagaactatttgaggaagtctgagtcttaactccaatttttgtcaaaataagttagttggtttaaacacatctattcttaaaaattagaacagaagaatattggtttgaagatattttaagagttaaggctgaggctgggcacagtggttcacgcctgtaatcccagcactttgcgaggccaaggtgggaggattgcttgagcccaggagtttgagatcagcctgggcaacatagcaagactctttctctctctctctctctcgatatagatatacatataaatatacgtatacaaatagaaaaaaaaaagagttaagttttatatggagagccatgaagataagaggtaaaaattaaaggcttgatggacacatgtttacatctccatcaagggggttgatgggaaagaatgatagacatagctccattactgctacctccttttaggaagttgcttctgaacatctaaagatatcagttttataatagaaatgagttatttttcagtgtctaaaacaccacatgagatacatacatacatgcatacatacataaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgtcccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgagtagtacaacacaattaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaatgaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatgggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtctgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgcggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggatgaccgcgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaaggctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcggacacacgcacacgccagattgtgcacacacatgctgtgaggccccacggcccgcatgcacactctaacacatgcccacaaacaacacgcatacgtcgccctctccgccacctcccggtgcccaacaccctcaccagccggcacgtgccgcatggatctggggcgtgcagccactcggcacactgaagcacatgcgtgggcagagtcacaacacagatgctcacccgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccaggctgccttgaagaagctctcccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacaccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcatgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacatgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctgggagcttcagttttcttatctgaaaaatgaggacacctgaccccttccctgcccagttcagtgttgtgggacagggttgctgtcaagacaatacccagtcctgccctcctccctgagtgggccaggtagcccatgtagcctcttcccagctttcctgggtggcactgcagcctggtgcccattcaatctagtccttcatcttgctggagcatggggaagctctgagtaacatgggactatagagtgcaagagggttgctgatggtctgggtcctgtgccctcctcattcctgggcattcttgacaaaggctcccagcaactgagggtacgcagcagctgtagacaccagcctgatgaatatctcattgtgggaagggcaccatagcaggagtggagctccagggaaatacagaaccgaggtctgggaggtgctgatgtgagaggcccaagaaacctcggctttgcacttgctgagtaccatctgcacctctcaggagggagagcgccaggctcaggaggtccttgccgaagcaagggagcttgaaaagggggctggggtgggctctgccattttcaagggctgacagggatcccctctggaggtacttggggcagtgctgtgtgccgtggctcctgagtgacagagtcagctctgcgccccacaagaccgctccctgccgagaactcactgtgatcatgtgctgggtccagatgctcacgcagcctcctgatgggagcatcaggtgtgctgcctgcccagggcggcccacaagagtctgccctgccctgccctgccctgctatggaacaactcccattctgcctttggggagaggtgttcatttaaaccatgagtgggctggcccccgtggcacagttaccacagagagtctgccactacccatggctgagagctctagttcttctctgaagccaccaggacagatgaacagtggcttcccccttttggccgactcagctgcctttcatcagctcatctgctcctaggatccactcttcctctggctggcacctgatctgagcccgaggctcacacctctgcccacaggccccagcagctgcttcacctccgactccatcccccaccaagcactgcccctcaccagctgctggggtgccactagtgcccctacatggttctccctctccagacccttgggtccagctctagcttccttcgggaagccacaccccaagaccccagccctgctctggggccctgtatccccgacttcctgcattcttctccctccttctgggaacatgaacttgccctgccagcctgatgactcctagagggcaggacaccaggtcctggaccatggcaggcctgggagtgtctgctgccggtgatgctggagctggtgcccatgtccacatgatgtccatggcacagtggccacctgaggctgggcgcatctgagtggtggctgcagagtggggcccttacctctgcctgagtgaagttcaccaggtcctcccctgtgctgtcatgctgggcgtggaagagccggcctagctggaggccccgcaccacatggtagagcaggagctgggggtcggtgcctgctggctctgaggctctggctgctgagtggctggacggactctgccagaggcaaaaggggccatcagcctttgtgatccaggccgaggcctgtggctgcagagaggcagtgtgaccctggcatgccaccctcagctctgccccagccccccgcacccaggaacgcccacaatcagcacacccacctgggcagtcagtgtccggctgccctccagcgagtgaagcacttgcttctgggccgtcactcagaagctaagtgtctggaggaagtatgttcaccgtcagagaggccaaagtggatgcctccgtccagggcccctggggacaagggtgttgggtccagctggcctgaactggctccccacctcagggtgcccccgtgggcagcagaaacctggggctcggccctcagcacccacctctgtgtgagaacagcacgagcccaccatccagctgggtctgcttgaagctgcgcacctcagtgcccggcaccgcccactgcactacccacccattgctgggctgcttaatggtgtacaccaggtccttgggcccagagtaaccatccatgctcctcagagcctctgtagggatgggcacggtggccccctcccacatctggggacacaggcctgtgaaggttctgccctgccacacttacccaccccttcctccccggccctgggctgccaccagggctccaaccccactgaggctcaggccctcaggtggcatcaaggctggcgctgctgtggctcccctgcacaaatggcctccctgcattcaccttccctgtcaccccagggaaggccaccctccaggcccagcatccctgctcttcatctgtcctagtcctgtgtgtccctcaagaccagcttgtgtacccaacccaggaaggccctagctcttaccgtcaccaagttctcacccccagaaacccccagcgctgaccaacagtgctccttaatctagctcactggtggggcagcagtctcctttcagaccctccatgtgtgcctggcaggggctgggcacaggtgggaacagtgattttagaaacgagcactccttccagctaagggaggggtgggaggcgcagagagctgaagcctgatggttggcactgtcctgcagcacagaagcagtgctgggatgggcccaggtgcttccagagcagttacgggccctcctcgtgttgggcaaagggggccccttttcaggcctcccactagcaagcagaacaggcacccgttcctgaggtcctggtaccactcttgctgggtcaattacttgtgggcagtgctgcagtgggactcacatgcccagaaaacagccctctggcattcctgggcttcctcccctggccgcagggagccctcaggccgagccttggcaagaggggccatactgtgggaggcagggccccatcactgggctcccggaacaaacacgggtagatggcaccacctggtggccgcactgccacacagccatcccagcctgtggttccagggtgctgtgtcccactcttctgtggcgtccgcaccatgaggccaccccctacaggcacatcctagaccaccaaagccccccggtgccccatgtcagagacagcccaagtcagccctcttgcggaaccttcagtggcttctgctgactggggaggacgcgccccagaagctggggttcaaagccctgccacgtgggcttagtaaagccatgccctttctgttccaccagaactacttttgcaatcatggagaagttccatcccatctctgggcctcaacttccacctttgccaaatgggggccctgctctgctgtggacaaggggcaggagtttgggaagccaagctgaggcctccacttgctggggtgaaggtgggaagcttaacggtcccaccctgacgccagcccttaagggcttgtaagtgattctttcaggtgttctggtcctaagccacaggagaaggaacagcagagccacccatggctgctcagaagtctgcctaccgtacttgcaaatgtccaataacaaaacctcccacctgtgttctatttcagcacaatctcacatctctccttccaacaactgcgtgaggcacacagtagtgtcctcattttgcagaggaggaaactgaggctcagagtgggggagatctgtgccgggaagtaggggacattggcctctttctcaaagcagacatggggggtggtcccaggaatatgctcacctgcaggcctgagtttgtatgaggtcgggggttggccattgacaggcaggatggtgacagtgaaggccacaggatggctctggcggtccatctcagaggcattagccatcaggacaaaaccgtcagtgtcttgctcccatcgtgcaggtactggatcagatgctcttccacctaggggcaggcccagggctggcagtcaggccccagcagtacccttcatgttctgcctttgggtgcaggaagagactgacccttttagggcctcagcttccattggtggaaaatggggaccataagttctggttcccagaggagttgtgaggaagaaaggggatattttattttattttgagacagagtctctcgctctgttgcccaggctggagtgcagtggtgtgatctcggctcactgcaacctctgcctcccagattcaagcgattctcctgcctcagcctcctgagtagctgggactacaggtgcgggccaccacacccggctaattttttgtatttttagtagaaacagggtttcaccgtgttagccaggatggtcttgatctcctgacctcctgatctgcccacctcggcctcccaaagtcctggaattacaggcatgagccacagcgcccagcccgagatacagcatctaaagcataggtctttctgaaatgtgactccctgtctcctctctgtataacccctggactgggagtccccggggctccctccactctgcccccagagctgggctgcagcccctgggcctctctcacagccgtacctctctccagcagaaggtgctgagggtcctggcttgaggcccatcctccttctgcagggccccatgccggggtggctccagcacctgcaggccaaggcccgggagagtggggaagcaggacctggcaacgcggagcagtggaggggccagggtgcagctgcgactgtgccccctctactgctgaagttttgtgcccccagtggggatgacagcaggcagcacctccagctccacgtgacgtcctcaaggggagcacccaggccgaggccacatccagcgagaaggcatgcctcagggcgggagtgcaggtagaggatcctgcctgtgtccactgcctcttgggagaagctctgcacggggtccaggctgggtggctcatctgccaagatgccacgcagcaccatcaccaggtagccggcactcggtgggctcttcactgagaaaacgatgtctgctggcggcactgcctcctgggctacctggttaacagaggtcatgaggactcacaagggaatgcagaggggtctcagaggggcccactgtggccctaagcagccagaacagccttgatcttgctccacttatttccccagataccactgctcatttagtgacacacacacatgtgggttcacacacacagcagccagacatgcagctggtcacattttttgtttttttgagacagggtctcactctgtcacccaggctggagtgctgtggtgtgatcacagctccctgcagcctcaacgtcctaggctcaagggctcagcctcccaagtagctggggaccacagtcatgtgccaccatgcctggctaatttttaaatgttttgtgtagagatggggtttcactgggttgccccagctggtcacatgttaatacccaccccacacatggttacggggtgtcggtcaacagcttgagatgcactccctcagggaggtgcataatcacatgtccccagactcagtgacacagacatatgagttcatcagatgctgacgcagtcacacaggtacaggtacacatgcgtgtgtgcacacgcacacaggccccctgctcaggatctgttcaggcctgtggctggtttgctggcagcatcctccccaacccctgctattaccacccaggaccatcagagggtgccctgccccaccccaccccacccctcctagaggcacaggcacccccagcacaggccctacagagctcacaccccaaaggccacatgggctccctcacctgatgggccatccacaagaggctaaactgcctccaaactcacattcctgttttgtgccttcggccggaatgttccttttgcgtggaataccactccccattctctgctcctaatggcctgtactcttcagagcccggcccaaacactgcctcctcccatgaggccttcctgatgccagatctgctggctcaccatgggccccaagctccagatgcagaccagaagggtctccgaaataagcagtgtggaagagtaaggctgagagcgggcaaggactggcctgaggtcacagggcatgtcagatctctggaaggcccgtggctgctctgtggggttcctgggtgagcagaagcccttgacagaccctcctggtcctggtctgggctctgagaagagagcggggtacacaggggtctgagaggcagcggcctgtctccacggccagcaatcccaaaagttcaggacccgtgatgccctcccagggaactgactgcaatgcagattctcgggctccacttcagagattctgtagggctgggtggcgtccaggaatctgcatgctcagccatgccatggacatgagtggacaccagctctagaggcacacaccactcccaggaggatgggtgtacagcaagctccccagaaactcttgggaacacaacatatatgggagcacatctgaggcacgtgcacacacacaagctgggaccaccacaggtacagcccaagtcacatgtgttcccggcatggaggctgggaggaaggccctctacctggtccacaccccgctcaccacctccagctcctcacctccagctggtcccttctgatctcagctgcctctccctggaagatgtagatctccttgtgctgggccagcttcagtggggctactgggccctctagggcaatggtcacttgtagggtggcatctgtgtgcactggtcccacatccattgagaaggccagggtgttgcgggagctgaggctgccattgtggccatagaaaacagccccaaccagcaggtcctgctgagagaaggctgtggctggctgagtggcttggagcaactgtccccagtgagggctgtctgtgacgtggtagtgggcctcatccctactgcagatgttgaggttggtgcccaggtggagctcggccatgttgatggtaccctggcctccttgaggaaccatgaggccggagccattggccacacagaggtaaggctccaaggcctgcacctccagcaccgtgatggcctggtgctgcccatcggacacctgcagcgggatccagccgtggtcagcctgagtgtgtgaacaggactcgcctcttcctgaggcccctcctggatgaagcggcagatgggctgcatgggctcatccgtggccatgatactgccagagaggaggtcctggtgggtcagcaccagctgggcctcagcaaagcccgaatcagcattgctgaaggccatgttgtctgtagtcagcagccgccacctaccccaggccacgtggaagacgcagctgatggtctgcataggggcgtggtcattcacaggctggatggccactcagaagacaccccatacctcctcccaggccacgtcaccactgctctggtcctgatggcagcaggaaatgggatatcatcttctgtgatctcggagtcatcatgctgctagaccagctggccatgcatcaggtctccattggtgaaggatgtcaccatagtgatcttgtcctgtgtcccacgccaagtcaacctcccatggcggggctgctccatgacctcatagaggtacctggcactgttgagactcttgatgaagagctggtcagcagagaggacacacccaccaccctcgggcaccacgaggacaggcatgtctgggtcaccgccaatatggatggagaaggtacagagtggggagaaatatggtggagctgtgacatggaaacagaaggtgtcctccactgccactgaggcatgtgccatggccccataggtcacctctgcagcctgtacgtcatcctgggtgaagccctgaccgtctgacagcatcgtgccctgtagttgaaagttgcctttcctgggagcctgaaccacctcacagtggaaggttggggggcttgggcctgcctcctccagggtggcctccaggtgggctgtggtgagggcctcctgctgggtgttctgagtgtgcagtggctccagctgcagcatccacacagtggctctctggatggtcactaggaaggacagattgctcaggatttcccagctcacctgcacctgcagatccaggttctccacggtgtcctcggtgtagtgctgtgggtcagtgctcaggtacctcacgtggccctgctccacatcctgctggtggaacgcctgtgtgacccaccactcagcatcctccaccccaccagccccctgcttctgcagctccctgaacggcaggcctccggtgacacggaacagcacggtcacatcctgccccacggcgctggtctccaccaacaggttggtaggcaagatgggcatggcagagccctgggccagatgcagccctgtgctgcggtggatttgtatggccagctggacagccaccaccttcagcatggccggggggctggcctgcagtccattgctgacccggaatgtcaagtcctgtgtagggccaccacagtggacatagactaggctgccggcctccaactcccagcaggagaactcagtcaccggctccccaggctggtctcggtgctccacggggaggccagagggggtgccaaggagctggaaggtgaggccctcacaggcagagtccaggtcataggcctggagaacctcaggccccagaggcttctgtgtgtgttccaggatcaccataaggctgccatgtgggaagatgatgtggggtgggtcattgacagggttgacctggatgggcaggaggtctgtttggcccctccgcaggcatgagggcatgggcaaccaagccatcactgacacctccagcaccagctggtcagaggtgtcctcagggccatcgtggatgaagcgggccttgcagttcaccacgtccaggagggtgaacatttttcatgcctgggcacccaggacatccagctcgagctcgctgtagtgtgcccctcaggtcacgctgaacagcacctgggatttacgcagttcagcctccatcagtgccagcatgggctgcacatgccaccactcaagccaggctgtgccaccctcggtcaccaccactgcgctgatagcagctggatgaaattggcaaagacaggaggtagccctggctcaggcacgcatggctcagctagctccacggacagccaagccttgggagccagggtggagaaagcttcataatggccataggcattgtctacctcctccagtctgcagccagccaccatgttgtgcgtcagcaaggcttcccacagcccctgcctctagccattgacactgaggtcttccatgcagccagcccagcagggaggcattggcagcccctggtgtcaggcctgagcggtgttcctggaggtgatgagaggcctctgcaaccagctccccaagaaggagactgtcacgtggctccaggtagctgaggactcctcagttcgtgtggggtactggtccatggagatttctagctggtgaatgttgatgtggatgctgaccttgtggggctgtgcgtcagtcacaggcacactgttgaggagcaatacagtaccctggcccttctcaaccatggaccacaggtggccctcaaatatgtccacatggatgaagtccccatgccagcctgctgcctggaaggccaagggtgcctgccagctctgtgtggtgagtgtaaactccagggttccttcatcctgagtgccccaggcaggcaaggcagccagagagtgggacccagagaagcccagggccacatcatcattggcagaaaactcttcagcacagccctcatgcttattgggggtcagaggctggaggagtctgcggccattgagagcggctgcatggaggcaacccctcaggggatggctggttcccctcaggtagggcaggccaagtctcccagtgctcccaacaaagagcccatagggacttctaggggggctcccaggactacagaggaggcattcagaaacccattgactgacaatgtgggccagtcctctgagacagtcagaactgtggtgtgggggacggagccactcagtagaatttctgctggggtctgcagcctcagctcctcctggcccaggacaagcctgacctgaggagagacggggaatgggagatggggggcagcactttgaatccatcatttcccttataaaagcacagtgggttccccacagggggccccagagcagaaaacctaggacaagggcctctggtgccactcctcttgccttcctgccatctctttattcatcctccaaacactcaccaaaggaaactctgggccaggcctggatgggctctggggaccctggtgtgaatcagatgtggtccttgcccacaaggaactgacatatagcaagatgctcttctagaaacccaacctgtatttttaaattctcctcctctttccttgagtgagaagcaccagaaatattgtcttggaatctagatttcacccctggaataatgggtaactgagaatccgttgatcagtccccctaagtttggcaaagtttctcgaggtcactgaaggaagccaggctaactgttcagggacagggagcccaggcagatgctctgtgttctgggaaaaaaaaaaaaaaaaaaaagctgcctgacctgtggtggaggaatatctcaaggagagatgaaggacatagttctgtcaccatgacattgacacaagaaatggctctggtatggtgctcccagatgctagaataggtgatggcagagtatgggaactgcagaggcagaacactaagaaccatgatcttggagtcctggtatggtgcatctctgtagggatgtggcatcactacctgcagagctcaacagccatcagcaccagactgcaccacataggtgttcaacagtgacaccttgtggcaatgagcagcaatgacagcagcagactgaccaagccctagtcctcttcccactggggtgtggaaagagatggctgccccaaatttgttaatttgttttttttttccttctaaaatagagatggggtctcattgtgtggctcaggccagtcttgaactcctaggctcaagtgatctttccaccttggtctcccaaagtggtgggattataggcataagccactgcacccagcctgccccaaatttggactaagaccctgggttcttaaactcttcctggtatggggtaagactcaagtaggagccacaagactccttgataataaagcttgtggtgtcttgaaggatgaaatggaaaaatgaagctgaggcagtactggtgctgttactctcatggacagacagtggtgctgcagataaattggtgcagtgccaccaggatgcgcaggggtcatgggggcccaggagggggtctcgccgaggaggaggggatgcccacactgaaacttcaaggagagactagagttcggcaggtacagggaatgggtgggtcacacacctggcaggaggagtgtgatgaccaaaggcctggcagcaagtgaccataagatggccaggaactgaaagcagttcagtgcagtcagagcacaaagggccagtgagggcttgtggtgggaaacatggttggaaggagccggtgggcagagccagttcatgaaggatttaccatttctgagctgctgctgcccatcccacagtggagaacttgagaccccaagaaaagtgacttacacaaggtcaacagccagctggggttcactcaaagctagacaaggaatctcgccccaatcccagggggacgtcactcacctgcaggtgtccagagtagagctgcagcaggaggtggtcagctgggcctgctgccaggagaaggagggcttcgggttgggacatggagaactgcagctgcaggtctatgtcagtcagagccatggccacagtcacctccgggtggttctaaccaaagaaggaagctgtgtgagagagggagctgtggtcaaggctcagattcttgcctggaggaggcgaggtgctgcagggagggatgggtgggttgcagaaaggggtccgtgctggtgcaccctcatggttctgccatacggtgctgcctctgagcactgcccagatcccagcatttccttggtcctggcaccagaaggcacagcctcaccttgtgtccagcccagaccttgacttggcaggaggtcagacccagaaattcccagcaactcaggtctcctccttggaggttcctggagccagaggcctctgccagctctgactcacctcccctgggccccagaggagtctccctcccaggtctggctccccgacctggcccaaagggaaacatcactggcctgatcacctggcttggtggtcacagccctgaggaatggagtttctggagaatcaccaccaggccagatcgatccctgctcagattccttctcctaagtgcccttgtgcttgggctcctgtgcagcacctgccgtgccatgccccacctccatgggttggctggggccacagctgggatctgggggtgatgtcagtgcagcccacctatccctgcttctccctcaggccattcttccagctgccattgagggtgggggcaggagcttattggcctgagtttgccaaggagtaaaggctctcaggccagatggggaccatatgcagtgtcaaaccaaagtgggcccacacttcctccactacccctgctgttgcttcctgctagagagctattcacagtccccgctgagcagtcagatccggccccattgtttccaccgtggccaaggaaccagggatgagaacagctcagctcccaacctccccaggccaccactcagtctgaggctgaagacagggcctagaaggggctgagggtctgctgagcaggccaaagagggcctccccaggcagaaggccatgtctgggcttgcctgggattagtggttcttatgcagggcctgttctgtcccacactgggactcctcctcttttgagttgctgcttcctccaggcagtttccccaaattagcctccctgacttccaacccgatgccataatttctggtctatgccttttgcggtgataagagccaaatataactttaactttgcctgcagatgtccagggctggggggcaggcaaacacaggttaaaaactgtgattcatccctgttgggtttccctcaaaccccaagaacaagcacaggctgatggccttgatggggtgatccagcaccgacctcacatgcactggtccctagccagcctgagccagctgccatctgctcgaggaagtagcttcagccattggaggagttggaggtttgtataccctcagggcagccagtcccacctggagggatatccaggaaagatcccgtaagagcccctcgggttgagttaaatcccctctagttatcccctcctcctgccagcactgctggcaacaccagcaccttggctgggaagctaagggaatcaagcaagccccgcagaccatctgcacgggggtggcccagcagtctcagcaggcacagcacagcttggtgccagcaagagacagaccagggaactgcaggtggcggccagctactggggtgccttatctgcaaagacattgattcctaagagcaaaacacagcacactaaagtgagggaggccatagcacaaggggtgggggcacatggccctgcaggatggagccaccacagtcaccggctggaacggctcacagcagctgccaggagccaactgttgaattttcaggaattttgagaggcaggtgatactgcccacagtgggaatatttataccaggaaaagaggcaaatactgaaaatcagggttccctctccccaacaaagccctttgcgaaacatttacctacccagcacccacggggaagggggcacatctccctgtgcctacccacctgtgttaatcagggttccctagagggacagaactaataggagatatagacagatatagatatagatatagatatagatatagatatagatatagatatagatatagatatagataatagatatagatatagatatagataatagatatagatatagatagatatataaaggggagtttatgaagtattaacttacacaatcacaaggtcccacaataggctgtctgcaagtttgaggagcaaggagagccaatccgagtctcaaaactgaagaacctggagtccgatgttagagggcaggaagtgtccagcatgggagaaagatgtaggctgggaagctaggccaatcttaccttttcatgtttttctgcctgctttatattcgctagcagctgattagaaagatggtacccaccagtattaaaggtgggtctgccttccccagcccactgactcaaatgtttatctccttttacaatgccctcacagacacttccagtaggtcaatactttgcagccttcaacccaatcaagttgacactcagtattaactgtcacaccacccttgcactaaaggtatacatacacccactagggcatggtcaaggtcagagatctgggccagacaggaactgaagtagatggttggccctaaccactgaaccacctgcctgcggcctcctcccatcagaagagagtagagcctgtttggccagagtggaatggtggcaggaagcagaggtactttccggagcgctggggtctgaatgggtccattgaggctgggccctgctgcttcctgtagggctgagtgggagaggctcacagaggctgccttgtgcagctggagcgcatagccagggaggcccccactccaacagaggcctctgaggccttgctggccggggctttggaaactctgacagcgctgcttccctcacctcctgatctcctttttctgcccctcttacactctctgaggggctgcagttgcaagaacccagaatctctgtcttggaggtagtggggggggggggcagttgaagaggggctttgaatggagagggtctgcacaataaagatgtaataagctaggagtcaatccagaggacttcctggaggaggtgatggtggtgtagagtcacagagagggaggaacaggcagtctcagaggacagcagcaaggccaagtgagagactggcagaggtatacaggtccccgttggctggggtgaggagggtttctgctccctcaccccccagagcctctggcttatcacaggataagagccagctaagctccaggggctttccaggaaaagtgtctcttggaaagggtgtgaccttttcatcggtcctgacagcaccctagaaatagcttggccttttccctcccctgagctccacagagaacacagccagcagaagacacattccctgtcatccagaaatgggtttgattctcagctgagggacagcaggactggtagagactgtcaggccacacagctacctacagagcacccccatgcttggtcgggggtgggagggatggcagggtctggctgtccacaggccgggcatgacagtggggcgcactggaagtggcgcactttggaggggcaatgtcaggggagagcttcctcttgttgggccacaagactccacaaggacagcacggtgactgattcccaatgctagaggcgaggcaatcggtcatgtgtaggtgtatgtgtgtgtgtgtgtgtgtgtgtgtgtgtgtgtatatacacacacatatgtgtgtatatatatatgagggtgtgtgtatgtgtgtgtatacataatttatttatttagatggagtcttgctctgccacccaggctggacctcagtggtgcgatctcgactcactgaaacctctgcctcctgggttcaagcaattctcctgcctcagcctgccgagtagctgggactacagtcacctgccaccacaccgggctaatttttgtatttttagtagagatgaggtttcaccatattggccaggctggtctcaaactcctgaccttgtgatctgcctgcctcggcctcccaaagtgctgggattacaggtgtgagccacagcacccagctatttatagatatttatagaatatgacctcaactatttaaacatatctgtaagggtataagtactttgataacaaagaagcaatacatactgatagaaactagctatcatgtcaacagtacttatattaggtagagaaattatgtgagatttttatttttttatattttactaatcttctcaataatggttgcttataagttttataatcaagaaaaaagatttctaaagtttttgcaaaatggaaagttatgcttctttatatactaaagacaaaaacaaaacttcctatttgaatacctttgacttttactgcagacttacagacccttgaaagaaaaggcaattccctcccactagttctggtgtcattctccccatctctcccttcacttccaccttggtcttctttctacttcccaccttggctagtggtctccacccaaaatgcttgcttggcttaatggttagaattcagggaaaaagagatcccgaattgctaatctaaactaagattatacatgtgggaaataataaagagaaaccaggtagtaaataagatttggaggacttaaaatacccagactttaattcctctaagattatagttattaatcatgtttttatataatattatcatttaacatttaatttctaaatataatgttcatgaggaaaagagaaaatagcttggtttctttccttaccgaactgttgtccttagtatcttctagacgttccagaactgatgtcagatttggctcatcagagtccacagaccatatcggtgaagaagatgaataggattcctgtttaacccagagacacctatgttaaatgtttacatacagactaacccaaatatgcaattaaaccacaccactaaatggcaagatgaccatggatttaaacaaaatgtatcagggggaaaaggcaacacgtttaaacccatgtgaggagctggacttctgagacagccattctccttgcatagcactgtctgctgctacagctcatagaagtcaacaattttcttcaacactggtaggcagcctctaaatggccctgatcaccctcacctcctgccattcacacccttgtaaaattccacccctggacctagtgactcacttctaacaaagagaatacagcaaaagtaacatcgcttctgaggtgaggctacaaggagactacgatgcctgccttagtcacccttctcctgctctttccattgctccctctgatggaagccagttgccatgtgatgaggtgccctatggagaggcccacgtgacaaggtattgtaaaaagcctctgaccaatagccatctagaaacggaggcccagtccagcagcctctgagatgaatcctgccaacctgagcttggagacagattctctccctatcctgccttgggatgatcacagccaccatcaacaccttcactgcctggtgagaggccaagccagtgaacccaaggtaaactggacagaatcctgacccacagaaactgagataatgtttgttattttaagctgctcaatttgttacagagcaatagataactaactcaaacaccataaaattctaatattttattctatcacacaaaccaagtaataccaagtaaatgccattactatacatatatttttgtaacacaattacatgtgattttttaaaaaagctaatgaactatgcattatgtgctttcacccactaacagacgttcccgctgttactttgtactgttctctattataaattggggaaaaaccattattattatatattagtttcagaataactaggttcaagtcacagaaaacaattttgcacaaacaactttaggcaacactgctttgaaaactgtaatctgagttaaagctgaagccacagaaaccaaatatttactgaaggttcctttttaagaaaagcaagatgggccgggcacggtggctcgcgcctctaatctcagcactttgggaggccgaggtgggcggatcacgaggtcaggagatcgagaccgtcctggctaacacggagaaaccccatctctactaaaaaaatacaaaaaaattagctgggcgcgctggcgggtgcctgtagtcccagctactcaggaggctgaggcaggggaatcacttgaacccaggaggcagaggtttcagtgggccgagatgtccactgcactccaggctggcgatagagcaagactccatctcaaaaaacaaacaaacaaaaagaaaaacaagttgtattgatggaggacatcattaacagtatatctcttcaataatggtttattttactattctcattcttctcattcctctcttactgtgttccaaatctctttacaggctaaaagaaactcttcagaattactcctattcttttttttcttttttgagaccgagtttcgctcttgttgcccaggctggagcgcagtggcacgatctcagctcatcacaacctccacctcccaggttcaagcaattctcctgcctcagccttcctgagtagctgggattacaggcatgtgccatcatgccccactaattttgtatttttagtagagacggggtttctctatgttggtcaggctggtctcgaacccctaatctcagatgatccacccacctcggcctcccaaagtgttgggattacaggcatgagccactgcgcccagccaaccctattcttaaagaacaccagttcctcagtattgcattttcttctataaattcttcagcatacactgagaatacaccatatggactatttttacacttttaattttcgtttttttttacttttggctaaggaaatttcaattagatttaggacttcattctgttaggttagtattttctagtaaacttcagcataagcaaaataaaatacgtgttgttgctctggactgaaacccctcaaaaccatattttaaaaattacaaaaaaaaattaactgaaatcaagtttttaaaaaccttgtagatgaaaagatatgatatctagtacgtctaagtacctatttcaatggttcccaaagtgcggccctcagacccccaagtccaaactattttgacaggaatactaacatggtgacatttgctgtaagtgtgcaaatacaatggtgggtaaaaatgctggtactttagcacaaacaaaagcagtaacaccaaactactagtagtcatggtattcttcattatgcacaggaaaggtttaaaaaggaagggtgggtgggacatggtggcctacaccagtaatcccagtgcttcgggaggctgaggtagacggatcacttaaggtcaggagtttgagacgagcttggccaacatggtgaaaccccatctctactaaaaatacaaaaattagctcggtgtggtggtgcatgcctgtattaccaaatacttaggaggctgaggcaggagaatcacttgaacctgggaggcagaggttgccttgagctgaaattgcacctatgtaactccagactgggcaacagagcaaaactccatctccaaaaataaaaataaaaaggaagggcaacaaaaggtcagtttcatttaagaatgtctatgataagtttgggaattttggctcatgtctgtaattccagcactttggaaggcccaggcagggggatcccttgagcccgggagttcaagacctgcctgggcaacctggtgaaacctcatctttacaaaaaatacaaaaattagctgaacacagtggctgcatgcctgtagtcccagcgtcttggaaggctgaggcaggaggattgactgaacccagaaagttgaggctgcagtgagctgtgatcacgctactgcactccagcctgggtgacagaacaaggccctgtctcgaaaattaaaaaaaaaaaaaaagaatgtctatgatgaagcagtgaatattttactatatctaaatcattgaatatatctttttaatatttcaagtgatgaaatgggaagtatacatgagcattcctacaggctgcctgaggaaaaacccttgagtgactaagtcttgaagtgaattaaccactttaatggaataccatttttacttgaaaggctgactgacaaaaaatgttattttaactcgcatttctggcagatattttctcaaaacatgagattctgtcatttcaaggaaaacaacagacaggctataataaaattcaataacaaaattactaataaaattcaagcttttgaacaaaaaattagaattttagaaaacttatgcccaccatcgctttccaaaagtattctgatgagattgatggtggtactgatgaatgtattttgatactgtacaaatgtatcaacatgtagaagatcttagtgaaccactgttttataagtgaccaatgcacgatgttgtaatatcatgcaagggtggaagatccaaagttcaagaaaaaccaagatttgatggagtatcaaaaaagaagcctaggcaacatggcaaaaccctgtctctacaaaaaatacaaaaagttagccaagtgtggtggtacacacctgtagtcccagctactctggaggctgaggtgggaggatcaccttagtccctggagactgaggctgcagtgagctgtgatcacaccactaccttccagcctgggcaacagggcaagacctcatctcaaaaaaatatatatatccacaatgatctaaaatggttatctgtatgagattggcctttgttcacattttttcaagaaaatatcacacaataaattgaatgcagaagcaaactgacatatcaatttgctaatgacatatcaaacatcatgcaaatgacatatcaaacatcaaaataatttgcaaaagatgtaagactgtactactttgggtttagaaattttcttttcataaaagcatttataacaatatgtggtgagcttttaaacaatattttaaatatttctgatttaatttctagtgataaataccaatagatataccctacataaaccaaagctccttgggacctcaatgtatttttaagagtgtaaaggaatcctgaccccaaaacttggagaactgctgccttcccctccactttcttccttctctagaatttcttccttggaagaaacatccctttgccattctatattaacttacatagttccactgaggcaagttttgctacctccctcccatctttccacctctctctcaacacaaaacctgaccaaagcattctaccagcccaccccatttccagtgattagctgtcaggtgggctaagccaaacaaatctgggttttccctgagactagacctctctttctgggagagatggaatcacagggacaaggttggccaccttggggtagtgagaattcatcctgcctaaacagggagaattcaaacaagtttctagaaagccaaactactttctagaaagtcaaagataattatattttttgccatgactgtaagaatgcccatttcattgcacactttctaacatttttaccaatctgataaataaaagctggtactgagatgaaaaaaaggctgggcacagcggctcacacctgtattcccaacactttgggaggctgaagtgggcaaatcacctgaggtcaggagttcaagaccagcctggccaacatggtgaaactccgtttctactaaaaatacaaaaattagccaggcatggtggcatgcgcctgtaatctcagctactcgggaggctgaggcaggagaattgcttgaacccaggaggtggaggttgcagtgagatcacgccattgcactccagcctgggtgacaagaacaagacttcatctcaaaaaaaaaaagaaaaaaaaaagaaaaaaaaagttcccatacaatataatttcttccatctctggaaacaaattcagcaatgagaactgaaagtcaccacgtggaaggtttcaaggatttacgtctacctactgatgtctaaagcattagttaagttacaaaaaaatacgcacacacgcgcacgcacacacacacatacccgtatgtattcagtaccagaaaacatgactgactacatggtaaagtcatccaacagaaagcacacaataactgaaggcaatgtagaggagtaagttataacatggatctacaatactgttgagtgaaaaagcagattacaaacaaatatctgatttttaagggagaggaaacatatacaagcacaggagaaaagaggtgagcagatgactggaaagatacaaatttctgacagtggcaccttctgagtggtagaattacataggtaatattttctagttttgcctaaaagttttctaaatttcttaaaataagaaggttttgttttccatattacaaaatatccatcaccccaggaaatttaacctttggcacaaactctacaacatgttcaaagtttgttcagttgaatatttaagagacaatctattttgaaagacatttaaaatgaccaatatttaaacctatgcattaatatttttcaatcacgttttaaattttgtaattttgataagttttagatccatcttgaaaagataaattttctgtttgtctttaaaatattacctacaatatgcctgtttttatacagttaatggtgctcaaaaatcgcaatataaattcaggcagtgttccttctatagaatgtgtaagtgcttctaatactgctctttttcaccagttatgaaaacacggaacaattatctaagcatctaattattcaggtcctttgtttctcctccattctgttagttttatactaatttcaaggcctgtgaggatgaagttgtctgtgacagctaccacaaaggttactataagcagacaaatttccagcaagtttatcaccactaccatcccaccataaaactgtctcaatcaagggcaacacaattcaaggttagtcaagacaacctctttacctgtcactgcttaagaaaaggattttttggtcttatttagaaataactttatctatttttctccataattccactgagaccaatgtgtgcctctatctcaagcaccagcaagcaaaactgcctgccagtatgttcagtttttgtatctttccaaatgtagggcacagctatcttttgatatcataattttttgaaaactgatgcacaaacttcttcttgaaagttcagccaggtgcggtagctcacacctgtaatcccagcactttgggaggctgaggcaggcagatcacgaggtcaggaattcaagaccagcctggccaacatggtgaaacctgtctctactaaagctacaaaaattagccaggtgcggtggcaggtgcctgtaatcccagctactcaggaggctgaggcaggagaattgcttgaacctgggcagcagaggttccagtgagccaagattgcaccactgtactccagcttgggtgatagagtgagactccatctcaaaataaaaaataaaaaaaagaatttcagatatacagcagttgtaattcttctgaaggctgcttatgggacacattactttcataatttgctgttcaataaatgtggggtggagaataaagtaaattgacagaattaccatataaaataaaattctaagtcctctgacaacaaaaacttacacacacacacacacacacacacacacacacacacacacacacacagctttccctgctaatcattttacaacaaccaagtagctaacccagagcccacaaaagcagagtcaaaattctaacacttggtaaaataaaaatgcacatatatccctgtcacctaaaaaaaaatgcttacgtattcaaagacagcaattgtagctactgagaacatcattgtaagcaaactgaggcagagaaaacaaacgtgctgatgaggatttgaaacacctaagctgcagaaacccactggatggtttcctaggttccgagttggcattatctttcagaacgatcttctagaagagatcacataacactgttacaaaggatctggagaaagggaccctggcttcatcactctggctctccagtcatgctttacattttcacttcttacactctctttcataggaagtcaatttacaggcttccaccaagcccttaagtgacgtttttgtactatccatgacaagttcttgatgttatgtctgcacttctgacaaattcttagcagttaacttactaggcagttaaggtttttgttcaagcacaatatagctagaatagggtcatacattcaataaaacaaatatttaccaagcatttattgagtggaagataaaaagcacaaagcataattataaaacattctcccctgccaccataaaaatttttttaaagccttacagaatatagcataacataaccaaagcaaaaataggactaaagaggggaggaaggggaaatatcagcatgaattaaatatgacccagaagagccttgatggtcagacacgtaaagacaaattgggtagggttagggggtggctgtcaggggcacattctacaggggaaaaacagctgatacagaagcctgaaaggaaaaccgggcagagcacctggacaggactcttacctgctgcatccagggtacaatgcgcctttccagaacacagcagcgacccggggtagagggatcgctcaaacagcaccagaggctgcattccaacttttcctccatcaacgagtccgttttcattgttagtttctccttaaacacgattggctgaacatgcgggaacaaggaaaacctgactgaagaacgaggcatttaagcttaagggccttggatctgggcgcggtggctcaggcctgtaatcccagaactctgggaggcagagatgggtcatttgaggtcaggagttcgagaccagcctggccaacatgatgaaaccccatctctactaaacaacacaaaacttagccaggcgtggtggcgggcgcccgtaatcccagctactcgggaggctgaggcaggagaatcgcttgaacccacagactgtcaagagatggaggctgcagtatgccgagatcgctccactgcactccagcctgggcgacagagtgagactccatctcaagaagcgcctgccaccatgcccggctaatttttgtatttttagtagagacagggttttaccatgttggccaggctggtctagaactcctgacctcaggagatccagctgcctcagtctcccatagtgctgggattacaggaatgagcactgcgcccggccaaaaaaccgaaaatcttaaaggcctttccccttccctcactgggctcaaacaacagcgggagccgccctgccacgccccgtcgcggtccaggggagcaggctagctgactgagggcgatcatgggccccaacaggtctgcgggcgacgcgggctcccacctcagggcgcagcgactggggcgagaggtgccggcagcccccaagccagccccgcggcaaggagccagagagacgcgccctccccctcctcccacgcaagcctcacacagcggggcgggccagacgcgggagaaaggggcgcgctcgccccgcctggggaaccggggcctctcccgggcaggctcccctttgtcccgggactctgggcgcctcctctccgccctcgccctggcccgtgaggccgccactgggcgcctcaccgtgatgttgcagtggagcgtgagctgtggcgggggctcctggttcttgtggaagatagaggccaacaacctcagcttggccttgaaccctcacacggacattttactctcacctctggcgggaggggcgcggaaggtgagcccgtcgggagccgctgtcacggccgcaaccacccgcgggacctctcggcggcgctctcccagctccgcctctccctgctgcctcaactctattcggagtagggctggaaaatggcaaggggcaccgaggcctctgcggggagctgtgtggcggcctgggcggctgctccccttgtaacagactccaccgacaggaggcgctgctcctgtcaagccgcagcttaaaagggcaacagcaccacagtccccgctaccgcctgggaaagggctgcccctaccccgctcccgtccctctcgcccctcacacccgtcgcccctcacccctcaacccgcgcgccccctgcgcacccgtttcggcggctgcaggagtccagagcatgcgcgcgcttccggctgccccctcctcgccttgacccagcactgctggacccatctggtccgttcttcacactcgcggactggaggctccgggcagcacaaccaccaactcgtgtgtgtgttggggtgggggtggggggcagaaaaccaccaactcgtgtgtgtgtgtgtgtgtgtgtgtgtgtgtgtgtgtgtgtgtgtgtctcccaagggaacagcactgctgagttcaggctatcagctcatggactgtcagcaaaatacagtcacaagaaggctatgtgctgttttgtctcttgcagtgacgtcatgttgctcatgttttatgtttttcagagttcattagtttctgtttgctctcagttaatatccagctcaatagattgtgtaagtagaatacccccaaactgaaagtcacctacataaaatatagtgaaaaatatgtcacccacttaaactatagttgaaaatatgtactcattagttttgtgtagccaacactggataatgggtaaggggaaaggatcccagggctagactgcctgggttcaagttccgatttcctgctggctgtgaaatacttgacagcgttcagcctctgtttcttttcttttttttttttttttttagcttaatcccaaatatgatagtaagtctcagtttcttgatctgaaaaacagaaattattcaatgacagtctatgtgaaaactttaaagttttcaaagccactatctagcttaggaaagtcctcagctttaggggttaaagtttttaaaaccactgcctggttcaggaaagccctcagctgtagccattattagctatgattattattgtggtggctacacatacattaatgaggcaggaaaatgctcaaggataacaagcaagtatccagattatctcatcagaccaagacagatgcatatgcatgcatgatcatgttttagctcagagccatttgtctaaaaggctcttgaactcagaggcccaggagtatcaactttgctttgcagtggagccatcgcttttgttaatcaatgaaattgacataatgctcttcttttttttttcctttttagcaccaaccatgtgcctagagctaagtgtgttaagaagagcatgcttcaagtggctggagtgagcaattcaacttgtggaggaatgagaagtgacagtgttgagacaagcaacataaaaccccagggtaaggtagaaatcactgaaagtcaggcaaaggaactggcgtccagtaatgagtcaggctttgccagcctctggccctacagatggctctttgcagaggaaaaaattaagccaggcccgagggcacagatcctaagggaatgctggcagctctaggctgtctatgagagtccagagatgctgcttcaccctggggctttaggcaagtccctttccctcccagagcctcagcatcccttctagcaaatgacgttctgcctttctcctaggatggctgtggggatcaagggagacagtggccatagggatactatgttaactgcagatgcggctgtaggagcactttgctaacttccagcgtgagttcagactcttcaggctatttggcacccagatctatggtgaggtgtgacatatgggatgtaaagtttgatgcctgctccgactccagtcttgctaacacacacgaaacctttggtaaatcatgaccctgccttggggaaaagggcagtctgggagagcttcttcaaggcagcctggcttcaatgcagtctggggcatgactgaggtaggcatacatggtgaggaactggagggtaactgggtaaagagctgcagtgtgggcagaggtgtagtgtgggtcacatcgcggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctctgaggtggagaaatgacagccggacattagtgagcaagccctgtctccgtgagcagcatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgtggcacgtgccggccggtgagggtgctgggcattgggaggtggcggggagggcgacgtatgcgtgttgtttgtgggcatgtgtgttagcgtgtgcatgtgggccgtggggcctcacagcatgtgtgtgcacactccggcatgtgcgtgtgtgtgtcccccacccccaggcctgccccacccatgcatgtgacctgccatgtgatttgaagctgtctttcagaatcactatcagtggcccctgaggagcgtcagccatggtaggtacatgcctcactgcctgctgcatgaatggtctgcctgccccgctgccccagctccacacagggggcatacctggagcctcagagccaggctccctgcccctcccttctggagctgcagacttgctctttcctctttctgtccttgtgctgctggctgtctcactttgctccctgtgagccacgggactcactgccactgctcaaggtctccatggctgagcctgggggctcttacaacaggctccatgcccaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccaagagccaaatccactgcagattaggggtgatagtcacggtcccacgtcctctatctgtcagcaatccagtggtgatctaggataaaagcctgagagtcctatacacgcggtcatcccacaacacacttcataggccatggaaggacacacagcccccttccctccctcccaggtaccatgatagctgctagcgtgcgactgaaggcagggtccctggcccctgctgaagcactactgctggccagcaggctcacgcaccttggcctgttgcttctaggggtcgcctgtgctattcagccaatagtgctgctggcccagctgagctccacctagagagctcacttccctttcctgccgcggagtctccctcttctgcttttcccagcaggaagggcccagcctcacctatgtaacctgcagccccccgccaaccagttgaggctgccctgttagacttagaagtctatggccaatggcatctggctacctgccctccctgccttccccagggtccctcagaggaccctgggctttctgatggcccagaggggcctctggcattcactccagccagccatcccttatagctccaccattttggttcaatcagtgttccttctctatcaggtctggtggctgttggatggggctctccaagcaagaggtggccctgggccgtgagttggaagacagggtgaccagagaagagagaagcccgagggggctgagcattcatctgaactatgggtggactgcctgggtgccatgaaagaggccagcgtgtgtggggtggggagggccgccgcagtccccaggcactacctatgaagctccggcttctccctccatcttcctcccctttcccttccagcccctcttttccaggaaccttgccatgcccacacctacgccctcccctccccggccctccacagctgctgcagcgcacccatactctgcacttgcctcaccagctctggcttttctctaacccgttttctctctgctttctctccaactgccagctgattgggtcaggcaagtccatcccatccggggagccccaggccccacttcgacctctaaacagattcctcctcttctcagagacctccctttccaagcctgcctgggtgggtgtcctgtgacttgacagtggctcccccagccccaaagccagcccccttcttctgtgacttagtctgttgtagtggtgagctgacacgtccaggtttgaccgttgctgaaacttgtgccccctctgtggtatgcccctgccctgttctataaatagctataaattctctctcacacacacacacacacacacacacatatatacatatatatacgtggccaactgcctcgcctctagcactgggaatcagtccccgtgctgtgcttgtggagtcttgtagcccagcaagaggaagctgtctcctgacatcgcccctccaaagtgcaccacctccagtgagcttccgggacatgcgcggcctgtggacagccagcccccgccatccctcccgcccttctggccaagcatggcggtgctgtgcaggcagctgtgtggcctgacagtctctaccagtcctgctgtcccttggctgagaaacccatttctggatgacagagaatgtgtcctctgctggctgtgttctctatggagctcaggggagggaaaaggccaagccatttttagggtgctgttgggagcagtgaaaaggtcacacccttttcaagggacacttttcctggaaagtccctggagcttagctggctcttaccctgtgaagccggctctggccactaggggacagggccctgaactcagcctggagggaacctgcggggcagccggcactctggagggacagacaggccacccggtgcagacaggagagggaggcagggggacagaacggaagacacctggggtggatggaagtcagtgcccttgggcactggtatctgtcttccctgccacagctagatcaggcttctcaaccagttggctgtcagggccagagtgtactccgtaggcgccatggcagtccccatgaaatccaccaggtgtcaccaggcagcatacaggtaacaggcctggaaggtccccaacagcccagctggacatgctgagacactctggggctcctcattcagtgggacaaactgcaggacccagtgagggaaatgggaacataccaggccgagcagtatggctaaatccatttattccaaaatcaaaagcaaaaaaaaaaaaaaaaacaggagtcccatcaccagggagccatgaccccatccccgcctccttcctcgctcctatgctagcaataaataagtttcccagtcgcgaataattataagaacctcttcctcatatgccagctgcaacctccgctaggtacgatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggtcttgtcttgctaccctaatggtaaagggctgactggggaggggttgtagggacatggtgggggtgaagactccagacccacttctccaggcttatgctgacaggggcctgcttttatttatttttatttttatcccatgatgtttttttaaatcccgtaacttctttttcagaactttttaaaaaaacttttcataaaactttttttttttacttttttcccacatctttttttgccacaacttttccacagtattttttatcccgtaactttttcatcccacaactttaattcctgtaattttttagtttgtgttcttttaataaacacacttacatggttacaattttgtaagaataaaaaccgattatctcatgccaagcatgcccagcatttgcacagtctcaatacctttaatactatagttttcaagacacacaaaatttttaggcaaaacagcaccttgaaacaatctaataatttattacattacagtagcatcacagaagcagtcaataatgccactttagacaaaaatcagtatttccatcatgcattctgtgtataagaattcataaatcggtaaaagtcgttctaagaaaacttggcaaatacagctttggactggaattggcatttctttctctacttttccttcccctagattctttgttttaagctacagtattcgtattttaaaatgttttaaattattttaagacattaatttaacagttacatttttgaatagttatttgaaagtgactgtaagataaagttttagagaatctattttggatagggttgatttacattttcacattttctaaaaatcagctttggttttagaactgattgtttttcatttcaggaaaacctatcaggtttaatctattactttaaaaataattatcatatattgcagtctttaaataggtattttgattctttacttcctacagaaattcaaatttattcagtcgaactcacattttaaaattctctctttctgctgaactctaaccttctaatattgccttctaagcaaattgaaagctgccttatactgaatgaggaagagaacaaatacttggctgaatgaggtactgcaagagactgcatgcactttgaagaaagacttgagttattgtcataggatttccattctctttagctttttcttaaacatatgacaaaatacctacacagagagtggtatttgagttaatatagtacatttatttttcagactgacattcagcttaaatatgccagtatgtgatttaatccacaggtacctgatgaacacattattgtcagattggttacagttgctaaacgctatctgaaggtcattcctagtcatttatacgtgtcagggtaaaagtgaagcgatttgaactataaaaatacctttgaaataatttatcaatgtattagataagctcagtttcagaatgataaacaaaaactgttagaccaaataacgtggctaattaacagtggtacgatttctagcccgagggtttaaaatggagttaaagtaagtgtctttaaactgaactcaaagaatgcaaaagcggcaagttcagacaaggcaagaacaggacctttagtccattttaagccataaatattacacaaaatatgcctctaactgaaactgagaggtataaaaacatatttcactcttcgtaaagaactttgtgaggaaatataactctgtgattgtatagacactttcctcatgacactttgacagtcacaaacagtagattgcgctgcagtttgtaaacattttacgttgcataaactgctccttgattttcaaatgtagtataatactgtctactaaaactcctttttgtttcaactaagtactctcacatatattagtttataataatgtttgttattatttttaaagtgttctccattcaaggaaaagaagtaaattcctatgtcagatggttgaagactagctattagccagagaggtctagatggtaaaatccatcttctagcctcaaataagctccatgaacacagaggaatgccaggtgtcacacagctttccttcactcgaattcattcttgactagagcctgtatatgcctgttccaggggcatttaaactcttaaaggatttcttctgatctttactaaatacattaaggagaacgccaaccagtgcccttttgtgtactgggacatgtagtcatgtgattaaaacagggaacatgaactctgactttaaaatgtattgtagatataaatgctctcagctagaaaaggttttccacatccacagtcatgatgggagcctttcattcctcagaaataatcccttttcaggtcatcaaaaaagagtacaactgccacagctcatgaggcagtatcttcatgagcccagagcacatacaaatcctaagggaactaccgtagtacagcgctcattcttggcaccagaacaaatgaaacatattctatcctgcacacacctgccaaagcaggccactttcctcttctgggagatttaaaaacctccccaaaatgttattactcccatccccaatacacagaaaaagggggaaaggctgtttccagtgctccacctttaaacaactgtaaatgtcagtactcacagtggcatattacaaagtaatagaccgcgcacttgagggcaaaccacatattgagctaatgaagagctcactgtgattaggattcgatcaaacataacagcagaacataaggaaattttatctgaattccgtaatgaatatacaggctgtactaacattaaaaaagcatggcagcctatcccaaaccagcaagaacagttgtgtgcatacagtgggtctttgtgtgtttgaactcccaccacataagggcaaactcgatatgcatgctaacgtcctataattatcaaattaaaaaaatgctaaaagatgccagagtgaacatgagagaaagacccactctcatttaactttttacaaataaatttaaattataaattagaaacacaaataaatttaaactataaattagaaacacaaataaatttaaattataaattagaaacacaaataaatttaaactataaattagaaacacaaataaacataagtggctctaacattcaaatgaagtaaatgaattgtgtaggatattaaccccttaaatgttttgttttttttttttttcaatttcttgacccgctcttagatgatggtgatgtttagctccctgttctccgcagcccgaaaagaatggcatgcagcctcttctgctcctcctgccgcctctcctgtaccaacagcttctccactcaagcctgggtgctcctggggagtcctgcattagaggaagcagctgctggatctgctgtgcagtggggttgtcatgggggagaaccctccctgtcctgtcccggtgcagcctccatgctatcagtgaggctcagctcactaagatcttcagagagagggagggggtgggaatctgggcacagtgcgagcctcccctgctcctgcctgcccaccccgcctgagggctctactcaccaccctgcttgtccgcacatccaagctccttgtgggactggggctccaggtactggtctggctgctgctgcagactcggagcctcttggctcttcagctccacctgccggaagaccctgggcatgaggacatgtggtggctggcttccagattcctggcccattaatagggtagcgagggcactgtggggctctgtggcctgcccaggcccctggccccttgctccaggcctaagagactgtctcccttgcctagaaccccatgcctccttccctagcatcaaatctcacgtcctttttcccagcatgtaaactgtaggccacagactggtggaaaagcaggcggagccaaccaccatctgctaagtgtgctacatgcctaatgtttccacgtattatctcatttaatcctcagcacctctgcaaggaaaaggctaacttccttttgaagttaaagaaacagagacttagagatgcaaagtagttgaattatgaccagtggaaccgaggccggaatccagtttgaatctaaggagtcttttttgtttttctgttttgttttgttttgagagagtgtcactctgtgtcccaggctgcagtgcagtggtgcaatctcagctcactgcaaccttcatctcccgggctcaagtgattctcgtgtctcagcctcctgagtagctgggattacaggcatgcaccaccaggcccggctaattattattattatttttaattttagtagagatgagctttcaccatgttggccatgttggtctcaaactcctgacctcaagtgattgtcctgcctcagcctcccaaagtgctgggattgcaggcgtgagccaccacacccgacataaggagcctcttataccactgtctcttcctctgtgattggggggctccatgcctctagctgggatgatgatgatgtccagacctgggagggccccagggctacccacctctaaaagtcagagggcaggaagcaagaaacagtcataggactgccccggagggtgctggggtcacctgtccccaggctgcagctgcctgtggcctggcacctcccctccccagaggctggtgcccgcctcccacatcttcttggatgggtcggaggttacagtctctttcagctcacccgacttctccagctcctttacttgctgctccaactgcagtgtgctcttgttctcgttgttctggacagagagaagcaatcagtggccacccactaaaactggagaccccagaacttagtgtctgcctcccatggcaccgggaagggtggaggcaggttagaaaaatatcccctctctcccacagccatcagagcggggctctggctcacagatgcctttagaagtaccatttcatgtgaaggctacaatgccccattttacaggtggggaaacaaaggccttgagggctagggaagagggcagcctccccaggtggggcaacgtaccagctcctcgaagccgctgcgtggctcggcccgctgctcgtacagggcttcccaccccagctccagcatcctctccagctcccgcagcctctccagctcccgcagcctctccagctcccgcagagtctcctgctgccacagcctctcatcctgttgccgaagcctctcctgctccaggagctcctccacctcgtccagcagcctctccctctccagcagcctctcctgctcctcctgccgcctctcctgttctaacagcttctccacctcttccagcagcctctcctgccctggcagcttctcctgttcacacagcctctcctcctgttcacatagcctctcctcctgttcacacagcctctcctcctgttcacatagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcacgtagcctctcctcctgttcacacagcctctcctcctgttcatgtagcctctcctcctgttcatgtagcctctcctcctgttcacgtagcctctcctcctgtctcctgttcaggagactcaacatctgattgttttccacctcagcctggagctgtcttcccacactctctagctccttccttaggtggttggtctcatcttgtagctgctctaccttagatggccctgctgggggctctggggccaggggttcagctgagaaagcaagcagagaataagggcctctggattctcaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccttagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggggaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagacacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccgagactcacatccccaggtgagtggtaaccaccagaagtggctgtgtcagggctactgccattgactttctttttcctgttagctcctgctggaatgccagggctcttcctctgccaatatgcttttaactgtgggaaagaagagcagtaacactcatgagaatgatcagcccctacagccacatcctcctttacagttttgacaaaatacccttatataccatctgatgtaatgccaccaacaaccgtacaaggtgttgtcacaatcagtgactgagagggattcatatcatggatagaaaaaaaaaaaaaagaaagatcaaaaaaggcaatactggaacttaaactcagtcctctgactccacgctctggggttttgccatgaatcagcagcttccagggaccaaaaccaggggcagaggtagaaaagcacacattaagcaggcaggaactgtaggccgtgtggtttagagtcatacatcctcacaggtctgctagcgtgaagaagcgtaccagtacctctcacactttcatatcaatgtgtcctcatggcagaaggcagcttttctattaaatctgggaatttatcagaaagaggacaacccaagcctcatttcagagcaaagtctggtatacgcttggaaacctatgtgtctgtcatccccaagtacattaatgcattttctcaagagaatcaagggaaaatgatgcttcagaaagatgtcccgcatttatcctgtggcactcaaagtaccccaggttgagacgatatgaggaagattcaagctgtcaagttcagtttcccaagatctattccacagaagatgagcaaatctcacttcagaggccactgactgaagggcagtctggtcccagaaccgtggagaactcagaaaaaaatgttaaagtctctctggaaagtagaagcctgggaaaaaaccaaaccaaacccattctcccattgccacccagagatactgtgaacattttgagctcacaggggaagtgtaggcttttcccactgtcaatgtctatgttaagggagtaaggcagcctgaaacctcttgctcctaggtcccatagtctccactccccttccagctggaaatttgtgctgcaaccagaggaaccagaaatggggtgagaaaacttaggggactgggttgtaagatcaaaggctggtcttgcagcagtaatgacagttcctaggggcactgtgacatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgttgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaacttacagttagtatatgagagcagttctcaaaaatgtagtctctggactagcagctccagcagcacctgggaacttcttataaatacacatcctccggccccaccctggacctgatgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagattttgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctcctcttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtaagcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattcacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaatcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaacacggaacgactgtggtgatcgagtagccaaaagttcacggaatgcactgtcacaattgtgattccgccatagcgccgtgcatccatccaacacttgtttaatacctatatttaatacctaataccttagactgtcctaggctgtggacacagaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcggggtgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaatcaaaaaccctcaaattttccttctttttttttttttttttttaaatcaagaaagggggtagataggtttgttttgttttagaaatagtttttatagcagagtgataccgtcacatttaatgatcctactgtgaattcaagaattcacgatgaaagttggattgagcggtattttggtgttcattctttgctgatactcattaatgaagttcgttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggacttctaaccttttttttaatctgtcggttattttttgaaaagaagtggggcttaactagtgctctaaggattttaacaagagattccgatttagaaatctgttcccccttttggtgaaattattattttttttagagtcagaatcttcactgttgcccagttgtctccccgggacccaagccgtcctcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcgtttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctcagacttgtttaaggtagaactggactgggtgttaacagtgttagttcagcagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacatggacacagggagtggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagttaacctttgaacttaacagattgagagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaatttttgtatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcaccgccatgcctggctaatttttttatttttgtagagacagggtctctctgtgttgcccagcctggtctcaaactccctggatgaagcaatcctcccaccatggtctcccaaagtgtagggcttacaggcgtgagagccaccatgcccagcctgctggggtttttgattgacattgcattgaagctggaaatcagttaggaggcaactgacattttaataatgagccatgaacatggtatatctatgtatttagaccttagatttttcgtcagtgttttgtagtttttagcaattggatcttgcttgcattttgtaatcttacacatttatttcatgtttgtggtactgttgtgaatgatacttctcaatttccagttggtgattgctagtatataggaagatgattttatgttatatgctgaccttggattctacaaccttgctaaactcatttttagtactagaagcttttttgtagatttttggaattttgtgcatagacagcaatgtcactggcaaataagggcagtttaatttctttgttttcactttgtatacttttatttccttttttttttttttgagacggagtttctctcttgttgcccaggctggagtgcaatggcgtgatctaggctcgctgcaacctctgcctcctgggttcaagcgattctcgtgcttcaccctccccagtagttggcattacaggcgcccgccaccacgcctggctaatttttgtatttttagtagaaatagggtttcaccatgttggccaggatggtctcaaactcctgacctcaggtgatctccctgcctcggcctcccaaaatgctgggattataggtgtgagccaccgcttccggcctaagaggacacagtttctttggcttattaagaggtatttggttagtgttagaccgggggttggtacattatagcttgctgactggatgtaccatgctgcctctttttataaatgaagttttattggaacacagccacacccattcatttacatattgtttaacagagaccatatgacctacagaccctaaaatatttaccactttgcgcttcgcaggcattttgctggctactgctgtggacaccaattttaatttaggtagataaacttttttgtagcttctgaggttttgcattaatttgctcaggcatataggttggtggaagtgctttctgttccttctcccaaaccaatcacacagccatataacttcatgcctgagtttctgtgtggtcctctatagtgagtgagtttttacatacttctttgcagcagcatgaatttcaaaaatctcaacgcttttgctcttgctaatctttgtaaactttgtacacccagtgctggtacattctgatgatagtgcccacactgcactctatgaagaaaagactgatgattgtttatattaaaatgcaggaagagaattgtagcggcaacttttgcttctctaatcagcagcatcataagagacttactatgtgtgggcaatgggggaaaacgttaatttatacattgagatagttgtattaaaattgagtgactcttactgtgacataaagtgaatgtgtctcttatacagcagaaaactattaaatttgttttttctcagcagtataaaataaagtggaaaatgtgggaagaatacaaatccttaacttctgtgcttctgcttatttcacacccctcaaatttctgattcctttcaactgtagctggctttactactgagtggtgaaattgctgaacatacttaaaactacatcatttaagactttgaattttgacatctcctcctcttcacagtctttcaaatactaggcaacctgtagggttccactgtgtctgtcatgtgttgtccctgtgttacatgaaagcagccccagtgaacttgtgaatttgctcagtcatttcactggctactgggtgaggaagaagtaggattttctctcttaaaattccttggtgaaatcattggatgggcacggtgtgtttctttaattttccttttggtcaaaaatctgacaaagcaaagactttcagttgttcttggtctttcaataggtttagtttttaagtgtgtctactctgaccaaaaattgccttcctgtaatatgctccttcctttagaacacagttcttaagtagagtttgtttgtttaaatgtataaaaataagttaatgcattctatgcagcgaggttttgcatcagaaccctgagttctcaatgtggcaggtttaagtgtctagaacaccttttacctgttttttctattacttgcttttttatttttggggtaaatgatatctttctcagggaggccttccctcagcaccatgtttaagagggcatctccctcatttgctattccttcttctgttttattttgctatatggaatttgctactatgtgaaaactattttaatgttttatttacctgtgttacccctagaataatatctatgaaggtagggatttttatctgttccttctgtgcctacagagtgttgaggagtatggtgtctggcacgttgtaggtgcacagtgacagctgaattaataacgtcagggagagtttgtaggatggggctcaaggtgtagggcaagtcagtttttagatttgaggttattagcaggagacgatgtggggggaaaacacatgttttaatgtcagactgggtttgaatctggtctctccaacttaccctttgaccttggtgttaaataatttaacctttgaaagatcaactttttcactagtgaaacgggaaatagtatctttttaatggggattaaatgtaatatcaaatataatgctctgtaaatgttagttttgtctttccccttgtgtgccagcattgtggaagtctgaaagcaacctgaatttaccagtctgtttctggagccttctggggtcattactttgattacttttgacagatacattcttttcagcagcctgcattgccagcataacaatgacctgtccctttgaccagtgtgggggacagacactttgtcatccctcttttaatccgtgtatcagaacaactcctacaagttctggctttgaaacatgtttagaggagtttataattccgaacagttcagatgacatcagccctttcttagagtcctctgagtttgctcagcttcctcattccagtgtggcgggaaccattcagttaaattgatgtttgtggtctttacacatagtcatcctaagtttcttgcaaatcatgagctatcagagggctactaagtcactagtttgtctctgtagatttctctaatccaagcttgtccaaccgcagcctgcaggctgcatgcagcctgtgaaggctttgaatgtggcccaatacaaattcgtaaacgttcttaaaacattggccgggcacggtggctcacacctgtaatcccagcactttgggaggccgaggtgggtggatcacctgaggtcaggagtttgagaccagcctggccaacatggtgaaaccccgtctctactaaaaatacgaaaattagctgggcatggtggcacacgcctatcatcccagctactcgggaggctgaggcaggagaatggcttgaactcaggaggcagaggttgcagtgagccaagatggtgccactgcactccggcctgggtgacagagtgaggctccacctcacaacaaacaaaaaattatgagattttccttttttgcaatttttttaaagcttagcagctattattagtgttcgtgtattttatgtgtggcacaagacaattcttcttccagcgtggcccagggaagccagaagattggatcccgcttctttaagttttatggattaacaaggggttaattcctgtatcagtttcactgatgtttcttctgcttgatgcaggaacacttgacaagttagttaaggtagattggtccataaatttataggttctttcattcccatgtcctaggcaagtctgagcaggacctggaaagctgattaaaaggccagtgagcacagtgagcttaattgtaaattaaatggatatttaatacattaagaaggcactcaagcctttcaatctttcattttcatccatgcttgctatttgaatctgatgggcttgatattgaccttgttcttcttgtaaaaatgttggttattgctgcctttctcaagcttggttttcagtgtggatttctgcagataatttttgcacctaaaagtacaaagtcattaagtgaaggcagtcaggaaggaaagagtgccctgagccaggaggtctgttacagcacatggggtggacaagaaaatgaatggacatgggcatggaggtggttcagtcagtgtgggaaggccacctgcttgtcagctttctactgcgttgtccagcagaacacgttgaagcttggggcctgcaactcgtgtagagatgattgcatttaggaggctgaggtagattttttccctcttaagtgtgtgctcactgctttttggcgaagtcttgacccgagacatacacagcttgatctgtgaggattttaacatcgagatggttctgttatttgagttaggcatggctaggctaccaaggcattgcttttcagtccaaacatttggtcatttcaatttattgttagtgaggtttttgcgatttgttagaacacagagtttgggattttgtctgttttttgcatgtgtgaatgacacttgatattgttgtttatattgctggttagtatgtgccttcatttacctattgtgagtaagaaacttcctcagatcaaattatagtgaagtcgcttggttctgtttctctgactcttaagaggatgagatcactttatacacaaactcaagctgtttggtaaaggacctaccattctgagcattcatagcctagatgaagtcctggtccaatcaccaagttaaacttttaaaaaacatgctgttcttaatgttcaggaattcaaccctggaagccttctctaaatcttaatgagagttttatgagaattcatttagtgaaaatatctatcagggaatccggctattaactttgaggagggtcatgccttttagtggttagagaggcaagctgtagcctcccttctcagagaaggggaattgaggaagagggttctagtggtcccttgcaatcctcccctcactttccaggttccctagtaagaccggaagaagtccctgagtaaacagcattttgtgagtttgagggactatgtaaaaatgtaagtgaacatacaatggttttgctttgataactgttttaaatatcctgttggttgttgaaacttctgtgacggtgaagccttttttgtctttatttttcaatcggaagatctttcttccccacttgaaaagattgagtctggggtcaatccctgaccccgcttccttcctaaatctcttagtgtatagcatacagctgggcatatggtaatctcaggcacgggattgtactcatagagctatgcttgacacctaggtctttagatggcttctatatttttgatgacaacttttaattttattctcatttattccatttctgtttcagtgtcctgggtcatgaaacttaatccacaacaagctcccttatatgcgagtaaatcatacgatttcttttcattttgtatttatttgttctgtttacttgttataataagccacactctcacatgatagatcctcaaggaaaattttaaccatatgtgcatgaatatattggtgtaagacacttcagaaattgagtttgatttagtaagtactaaatggctaatctgtgcatggaactgaaaacaaataatacctgtaagacttgcgagttaatttagtcagggcgatagtatgcacgtatgaaacaaattgtcctgccaaacagtactgtagcttcttattttttacctgcagtgcattcctgtaaaagtagtgtggagatcctcctactgccactgtgatttacgttatgttgccactaggtggcactatgtcattggcaagagtgctgtgttctttaggactctgggtgaaagctgatatatcatctccctgaagtgagggactttgaagataaaattgataaatgattgaatcaaggctggaaaaggtaggctgtaggcgactattcttcattattgtaagagtgaattaattgaatttgggtggtgaaaagtacccgtttgatgagaagccagcttagggttgtggatggttagagctgtgagaggccagtagatgctgggttgctatgctctggagagggtgagaaaatatatttgtaataggacttgattccagccttcaagaatatggatcatttatttggacaaaacgtccccagaattagttgaagacaaaaggcaaatggtcaggaatgggaggcagtgaacatagtgttggatgaatagtggggggatggtcagtggaaactctggcccacccaagtttgtgtcaggtaataatgggagataagcctgaaaaggtggataaagctcaattgtgaaggaagacaaaggtgtgaggattttgttttgtgaccaccgaggagccattgatggtgtttaatttaaggatgcttttccttttatgcgtttgtacataaaaacataaatgtacttaaccattctgtattaataatagtcatttacctttccaacataaaatgttcatgtaacttctgcatagctgatttttacgttaaatgtaacatgtaaagaaatatatgtgtgtttttagaagacgtcttatgtgctcattttctttctagattacttggagataatttatgtttaccagtggttttgcatgtgaactgggtaccttgggttatttattattattattattattatttagaaaacgggtctcgcactgtcatccttgttggagtgcagtggagcgatcatagctcgctgcagccttgaagtcctgggctctaagcagtcctgcttcagcctcccgagtaactgggagtacaggcgcatgccaccatgccgagctaaatcctcccttttaaagtgtgtgattctttggtttttcgtgtgtatacagttttgtaattgccattgtctgaccagaacattttcatcaccccccaaaaaaagtgccatatccattagcagtcactcaccattccctgctcctctcaggctgtggcaaccacttgtatacttcctgtctttattgatatacctattctggaaagttcatatatatgtatgatatatatgatgtatatatgatgtatatatgatgtatgtggtatatatatgatagatatcatatgatatcatatatatcatgatatatatatcatatgatatatatatcatatgatatcatatatatcatgatatatatatcatatgatatatatatcatatgatatatatcatatgatatcatatataatatatctatcatatctatcatatataatatatctaccatatgatatcatatatctcatgatatcatatatctcatgatatatatcatgatatatatctcatatatcatatgatatatgatatataatttttgtaaatatatatgatatatcatatatatttgatatatatgatatatatgaaaaatatatatcatatatgatatataattttatatatttatatatagaaatttatatatataaagttatatataatatataattatatatatataaaagttcatgtatatataaaatcatgcaatacacggccttttgtgactggcttctttaatttagcatagtgttttcaagattcactcatgttagaacatgaatcagtaccttgttctttttattaatgaatgacagtccaatgactggttacatcacattttacttatccattcaccagttgatgggcagttgagttgtttccacttttggtctattatgcataatgctgctgtgaacagcaagttctggtgaagacatatgttttcatttctcttgggtatatacctaagagtagaattgcttgggtgtatgataactgtgtttaacattttgagaaattggaaaactgttttccacagtggctgcaccattttacattcctaccagcagtgtataaggacttcagtgtttccatgtgcttgccaacacatgttatctgactttctgatctatagccaccctaatgggcgtgaagtgatacctcattgtggttttgattgcatttcccaaatggcaaatgattttgagcatctttttatgtgcttattggccgtttttccgtatctttggagaaatgcctattcacatcctttgcctgtttttaaattgggttgtcttattgaactgtaagggttctttgcatattctgactacaggtcccttatcagatacatgacttgcaaaaattatctctcattctgtgggttgtcatttcacttccttgatgctatcctttcaagcaaaattttcagttttgataatgttctgttgttgatttttttttggcatcatatctaagaacaattctttgcctaacccagagtcacagagatttactcctatgttttcttctagaaattttataggtttagctcttacatttaggtatgtaatgtgagagttcatttttgtgtgttttgtaagggaagagtccaacttttttcttttgcatgtggatctctagatgttccagaagcatttgttgaaaagactgttctttccccaattgaattgtcttgggcatcgttgttgaaattgatcataaatgtgaggaattttttctggatgctgaatttgattcctttcatttaggttgtctttgatttctttcaacagtgttttgtagtgttcattgtataaacttggtactttcttgaaatttgttgcttatgattttattcattttgatgcgattgttaattttgttatcttaattgttcagtttttgattgttcattgattatatatagaaatactattgatttttgcataccggtctctgaaactgtagccttgtttcagaggtcaattatagactataatctggcttgtttgtttggcaacagctcttaagtggatgccttaggattttctatgtacaggatgaagtagttggagatcgttttcttcctttccaatctggatgccttttatttctttttcttgcctaatcgccctgagaagcatctctggtacaacattgaatggaagtggtgagcacaaacatccttgtcttgctactgatcttaaagagaaagcatccaagctttccccattaagtatgatgttgttaggtgtgggtttttcacaggtaccttttgttagatgaggacgttcccttctattcctactttgaccatttttatgatgaaaacgtgttggattttgtcaggtgattgaagatgctacactgctggcttagaacatggaggaaggagcctatgagccacagaatgcagctctagaagctggaaatagcaaaagaacactttctccacatagagactctagaaggaacacagccctgctggcactttgatttttaaacaagtgaaagtcattttggacttttgacttccagaaatgataacatgataataaatttgtgttgtcttaagccactgagtttgtgataatttgttgttaacagcaataggaaactaatagagtagtagtttggggaaattagtgataaaggataattgggtaggagaggataaatgtagttaggtcagtttgagttctctgtgtgtttcactgtgtgtgttttgtaacattttagtttttcctaaaaccaaaggattaattgaccttcaaaaggcagctactttttgattttagtccgtaaccttttatcaaatcagtattttccccaaatagggttgacaagaagcattctaaattatctcctaataagttgttttgacttcagatattgaaattgcaggcccgtctcccacccatctctgttttctcaccttttttgtacgttttataataagccttacattgaagtgtatgtgtctgtctgtctctccctccttcccccaccccctccctctccttccccactctgtgtgtgtgtgtgtgtgtgtgtgtgtgtgtgtgtaattacaaagaagttgtaaaggccttttaaagtagttatgatgtgatttcccctccttttaaaaaataaaatatgttaagcataagtattaacatcttagagggcaggtaggtggagactttgactttctactttatctttgaatcgcttaagtgtttacagtgagcgtgttatttttatggtacatagtaatttttgatgaaaacattttgaaggctgaaaagactgtcctgtcttttgaaaataaacccatctttttgtgctaattaacaccggaggccagctaaagctttataataaaatattgcattcaaaatacctatgaaagtggctagttgaagactataatttgctttgaaacgtagcttgaaatggaaatacatttctaataatgaaaggtgttgctttagtaataaatgaaaataaaatatcccattattatcccttcatagaaaacaaatacaaccctaaatgacattttaattaaccagtgattttcctctaaagctgagatttgtttttttaatatgtaggtaggattggcaaatagcgtacagaaatctggacatcctttgaagataattgttggggtggaatgggggcatagagtactgttttattgtgttcatttttattaatgaaactgaatttagaccaagcagtgatttcaaagtggaagatggaacaggatgtttagtaggttttgtagactgtttttgtaaaaggctttggtgcagaacctttcataaaatgaaatattttttcagcatgtctgttatttacttttagaattcagagcaagggttcttgtttgaagaactacaaacctttattgactccagatttgactcagctcttttatattttctttctcactgataagggaaggtactttataaagtagatttgtcattaaaaaagaaaaaaagactacatttacctggtcagaagttcttttgggtttaaagaaaaagattgcagcccaggttgcaacaaatggtctgacagttataatatgttccacctttcttttttttttttttttttgttttgagatagagtctcactcttttgtccaggctgaagtgcagtggcacaatcacagcttagtgcagccttgacctcccaggctcaagtgatccttctacctcagcctcacaagtagcactcaccatcatggtggctaattttttttttttttttttttttggagagacggtgtctccctatgtttcccaggctggtctcgaactcctgggctaagtgatccttctgcctccacaaagtgttgggattacaggtgtgagccaccacgcctagcctcaacaaaaattgaactatgtactgtagccaccctcaacagtgataaacttttggcaaatcttatttcatttatactccactttggattattttgaagcagattccagacagatcacttcatctgtaaatatttctgtttgtatctcttgaaagtaaagactcttttaaccatggatgagtgttttgatcaaatcaacatggcttgttcatgtcgataccatttgctcagaggggaaagattaagggaaaaatggggttggatttgaaatgccaggacctgtctactgggtttgtgatttgttattctctaaagttgtagctcttaaaacaaagaaaggagtgagtttggcctattcattaacttttcctctttagacagttcaaatgtttattgagttcttctacaagccaggcactgccttcttcttgcttaccaagaagcatttttatgcggtttctctaatgtttgggtgaatgggacctcattaagttgtttttcacacaggtgcgtgctcgttcctgaagagtcctgtccaggtgctctgcctgcttttcctttcaggcttctgtatcagctgctgtttccctatagaatgtgccctgaactccaccccttaaccctacccaatttgtctttacatgtctgaccatccatgaaggctcttctgggtcatattcagttcatgttgatatttccccttcctcccctctttagtccttactatttttgctttggtcatgttgtcttatgctatattctgtaagcctgttcaatttctttatggtggcaggggaaaatattttataattatgctttgtgctttttatcttccactcaataaatgcttggtcaatatttgtttcattgagtatatgacactagtctagctatattgtgcttgaacaaaaatctttttttttttttccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaagaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcgaacaaaaatcttaactgccttgtaagttaactgctaagaatttgtcaaaagtgcagagataacatcaagagcttgtcatggatagtacaaaaaggtctctaagggcttgatggaagtctgtaaattgacttcctatgaaagagagtgtaagaagtgaaaaaaagcaaaacagagtagatgttttactctgtttgccaagggatttgtgctatttttttttcctgttttataaatttgtcctaatcttaaataatgaagggaaaagagcactctttttcaacctcaaggaatcctttttatacttcttttctatgaagccatgttatgaaagattgttataccaacttaagtatagtttttccatcttcagtaacagacgtgattgccatctagttactggttctgatcaccccaaaatgcaaagcagcttgttctaataacttatgcaggcctattgggagctagtatatggctttgagtccttttgaagtatttaacataatttggcaattccattactccttttatggacttcttggcatctgtgaactcttggtagggaatcactgttttagaatgaaaaatatctcccaggaagtaaattagccagtaaacaaatgaaacttcattttttatatgacttgtagagcctaaattattactctttctgcataagtggctgctttctaggctgcttttagcgagattgttagaaacaaatgatcggtgctgtgaggaagaagcagcactcaggcaaaaaagttttctcagcaagacaatttgcttctgcaagtatgctgcttgcattagtcatgattgcaagagcacaccaaacggggtggagcaggggttcttatccctaacacagcccctgcctctgtgtcattccaacatgggctggggtaggactgcacaatcttagctgactcagttggatattgtgaatattttctctaataagaaagggagggggaatgtgagttacaggttgggactggtaggaagagttgcttacaaggcaggttactaagcaggtaactaagctggtaagtaggttcgagaaggtacagggaaattgttcttaggaacaaagaacaaggaagttgaacaagttaaacctttgaagaggaacttactgtacctaacaattcccccctcttaatttttgtaattcttcctcttcaaacttttttagcatgtctttgctttgctgttctgcttggttttctagaaggaaaagcttatctgaatagggtggaggagagttaggagaggttttggtaagttctgtgtctatgagtctttgcagtagtccacgaatgtatggtatgatacagcatccaacaagaataagcacacttataacgattgcaagagaagtaaatattgaggacgttaagtctttccattttccagaccatttctccattaaacttgtaaagggatcatttattccagaattgcttgctaactcattggataaggaggttaggccctgcaaagcttttgttactgttccgtcaggggctgtgttattaggaataaaagtacatcattggactccaatcatgacacagacaccacctttttctgctagcatcgtatctagggctatcctgttttcccagactatttggttagtgggacctaattggtcggctgttcccttaatagcatgtcttgtgtagttaacaaacctttgttggttgtaataaatgtagtttatccactctacatttttatttacagttgaccaccaaaacagcacagattcaaatcctgcagctgtttgatttcgggccttaaatttatctggtactcctcgtggaactccaatagcccctatataaatgtgggagtcaaaggacccatgaagggcacttcttctcttatgattttctcttctattatgttaatggaatgctagggtgaaagggatggccagttggactagagcaaaagtactactacagttacttggtggagtgtccagtaagggtccaccacaataccaccatacgtatgctcgaggatgaacaagggcagactgactggtaagctcttgggaacgtttaagttcaccacatccctttaggtctccatgaaatgccaagttttccccttgttgtgagagacccgaggtaaaaattggtgtcagtagacggaggctggatggctctcaggggctgacctgcagggtgttggacttcagggaatagcagagagagaacttggcaggattcattaccccaggctgtggggtcttggagaagagctaccatacagctcatgcccagttggctggaagaccatccgagtggaaaggggacaacctgggcctctggcttactgtgcacacaagtctaacaattgcttttgtttagagtgcggacagaatatttaatccattctaaccaagcatttgcatcttggtaccctgtctcaattgctatggttggtttcaaatttttaacttctacaatggctaccttgattttatccttggttgaaggaagaacagtggtttcgtttggagagagtgtagaaggaggtggaggaggtgagaaagtaatgaaacacatttcaaaggattctataagatgtgtccctgctattttggctcccatgccgtataagcgacttaaagtaggtttagggttggcagaagtggggataagaatagaaatttgcactggattacattggttatactggcagttggggggcgggggatgtttcctttaacaaagcaaacatggttttagggacttactgttgacaaggtccagccctgatgttcagttgtccacataatatcattccagctatggcaggcctgtttccctaaatttcttaaggaacaagagtcgtaacgggggagtcttttgtctgaaaggggcagagatacttctctgaggctgagagttgcttttgactttggagatctccacagggtataacaaggcaagcatcaaaggtaatagtttggggtgagctcgacctagttacattaataacgagaggactagcaatagaaggggaaaagaaatacagcataagaggatcaagcccgttttagctttaacttggttggagttggccctgaaatagctgtccatgattctggagtgggtggtgctcttttgactcaggtatggtgagtccattcttttttggtggtgtggaagactgtctcagtcattagaaacactggataaggataaggtccctcccaggtgggcttgagcttcccttctttctaacctttgatgagaatgtggtcactgtccgggctggtggtggtgaactggaaattcaaggggtggtgtatgtgccaagaggcctttagtcctaaggaaagagaaagtggaggatagaccaagtatatagttcttgagaaacagatcttttgtttcgaacgaggaatgtcagcagtggagtgtagataaggcaactcatagagcatttcataaggaggtcagccgacatctttcctaggggcagtttggaatcttcacaaggccatggggaggcatttagtccatggcaaccgagtctctaggactaatttggttaggtggtttttcagagtctgattcattctttctactcttcctgatgaaggtgggtgccaggggttatggtagtcccatgttatatctagtacttgggctagtttcttaagaacatgtgcagtgaaatgagtcccattgtctgaatcaacattttctattaatccaaacctgggtataatattttcaactaatgccttgagtacattactagcagttgcacttgaaaagggaatagtttatacccaatgagtaaggtgatctatcactaataaatattttaagtgaccaattgggggcatttcggtgtaatcaatttggacactttggaacagccttaatcctggatttctccctccaacaggtggttttctgaggatctgcttattagtcttcttacatactaggcaactatctgtaacttgtcttgccaaaatataaattcctatatatctgtagaccccgaggactgcatcacacgtagcttgaggtccctaatgagtcccgtgatgcagatgagagagaatttccctcatgaggggtttggataacatttctctttggtctggtgacacccatttcccttctgaattttctttggctcctatttttgttaatttttccttttcagcgggagaaaagatggggactgcagtcgagggaggaaggcaaggggctaagtgaaaaacaggcattttcagaggaaacggcagtgtgtttggctatttgatctgctaggttattccttccgctttgaaaagaaagacctttctgatgtcctggaacatggacaatagctattctggcagctgcaggttatctaattcttggatgattaattcttcgtggcccaggtcttggcctttgctattaataagacctcgttcagtccaaatttttccaaaggtgtgagctaccccaaaggcgtacttggaattagtataaatagtcccttcttggttttgcaagtgctttaaggcttgatttaatgcaaacaattcacatgtttgggcagaccaattatttggcagtcttctggactctgcttcttcaagtgcctccccatctacgactgagtacctattatgcctttttccttcaattacttgggaagagccatctataagtcctgccccgttttgtaaagggtctctcttaaatcaggcctaacttttgtatgataattaaatctaaacacttatgctcaggtctctttagatttggatctccagtcaggaaacctctgggttaagtgaattatcattagtgttaaatcatctctttctaacaggatagcttcatactttaaaattctcaagtcagtaagccaccttcttggcttttaatttaagatggttctaacctgttggggcatgcttacagctaactttcccccaaaggttagttttctgctttctttagttaacaaggtgatagctgcaatggattgaaacattcaggccatccacaggttactggatctaaaacttttgataggagatccatgggttgctggtgacctctgtgttcttgggtaaggacacctaaagctacccccttatttatgttaacagaaaggtgaaatggcttttctagggaaggcaaagctaaaacagaggcagttataagcagatgttttagctcctcaacctggtggagttcttcagaagtccacaggagagggttaggcttttcttgggtgagttttaggtagagaggctttgtgactagggcatattagtcagtctataagtggcaatatccggctatccctaggaattttctgagttcttgtttagtcttaggcaaaggtatggatacaatcccttcaaccctctcaggccctatccttcgtttgccgttacttataaagtgtcctaggtatttaacttcaggctctatgaattgaagctttctctttgaaacccatagtccctctccttacaaatggttaaggatatggatggagagagcagataccttttctatagcttaaccggatattaataagtcatctacgtactggagcagacatatacattttggggtataaacttgttctaacacttgttctagaatttgaccaaagagattaggggaatctgtgaagccttggggtagaactgtctatcgatactgttgctgtcatccatagtggggatcttcccattcaaaagcaaaaatgtctcagctgtcctcatccaaggaacatgctcaaaaggcatcttttaaacctattactgtaaaccattgatgttcgtatggaattttactgagaatggtttaaggattagggacaacaggatgggtagtctagactgtctggttgatggcccagaggtcttacgctagtcaatatgacctatctggtttcttcacaggcagtattggggtgttataaggagacatagagggttcaaggagcccatccttgatgaggctttcaattataggtttcaggcttattctgccttctaaaggaatagggtattgctttcttcttactatttctccatgggtttttaactttatatgtatagggggcatttggagttttccccaatttccttcccttgcccaaacatcaggatgaatgtatgttttcttctgcagtggtgagcaggtttaatgaagtgtagaatccttctgagccaatacgtaaacctatacctaattttaacattaagtctcttcctaatagattagttcctggaattaacaaaaattcaacattagctgagcagtttttacatctaatttctgtttcttctaaaatttttagtttgattccctctccttttacccctgagactacaagctcctctgaggaccaggttatactgtggggaaggtaacaaacaggagcaggctgctcctgagtctactaaaaaggtcgtaagctcagatttgggtcccacttgtaaatttatcaagggctcttggtgggtgggattcaaggtaaaagagagagagcccctaaccccctattcctcctcaaaggtcgtaagtgggacgacttctctttctgattttaattcgggacaatacctcttgaagtggcctactttctcacaattgaagcattgattctgtctcatttatttttgggtttctcggctttgcctccttacgttctttatatggcttaggaagtgggggcctaggatctttataggttttggctctcgggaggctttgtttgggagtgtgtgggtctccgggtaacagagagtaatactggtgtgttttatcctttggggccccctgttggaaggtggataacatagttttcattttttctttttgcttctcctcatccctccttacacacactttttgagcttctctaagaagttcattcatgggacggtcgttccaattttctatcttttgtaatttccttgtgatatctggctgttagtaacaaaatgaagctttaacattcactgcctaagaggatcttctaaatctagaacagcatattttctcatttgttctttcaagctgtctaaaagtttgataggcccttcatctttcctttgttgtatgtcgaatgctcgagtaagattttgggttcggagtactgactcctgaatcccttttattatcatttccctaagttcctgcatatcctcttcagtgggctgtgttattattgtcccaccgggggtcttggttggggaatttttgatctgctgcatgaatgtgttttggccaggagggtgttcatgttcccaggctaccatagcagctctacagatcatgcttctttcttcccctgagaaaaggatgcctaggatggacattaactcagcccaagtatatataactgtggtcctagaaattggttaatttgatctgctgttccacaggagttgtctaatagtgcggcttgaactctgtttttaggttttggacctcccagctggttaaaggagcatttacaaagcgaatacttcctcctcctagggacacctgtcttaaggggaagagaggtggagctaattctcccgaggtagaggggaaggggaagttctgaatatcccttttacattgctctatctcacattgaaatcctttcagggaagagtacttagggtggtagtgagcaggctcttgggacgattcccaggaggcagggttatacagagggggaacaatgtgggtaggaaaagggtctgggacaactgcctctgcttgagggggagggaggttaggtttaggggtattggacggaggaaggtggtggaggaggttccatgtgttggtgagctgtctaggaacagggaccttatctttctcagaggagttaatttctgacttgcttttcaggattgattcctgagtccaaatgaaacaacaatattttatcatttgctgctttttcttgtattgagtcctttcattctctttccaatattttagcataagccgtaggggactatcaggaggaatgttattgtcaacttgtacaaaggaaagaaacaaaccttgattcaggagcctaggactttttctttggtttgccctcctgggacagattaccgttccaaattgaatttgtggaggagcgttgggaaatatcagaactgtcatattaagcacctaagtggtacttttaatagaggagttattcagaaattatattaggcagatagagagggtaaggaggcctcagtaaggctttcccttttaatagaaacaactccagaaacatttctttttcttttctttttatcttttttttggagacggagtctcgctctgtcgcccaggctgaagtgcagtggtgcgatctcagctcactgcagcctctgcctcccaggttcaagtgaatctcctgcctcagcctcctgagtagctgggactacaggctgccaagctttgatatgcaaataccagcgcttagaaactgtgtccattcaacatggagattcccaccctcttcttctagtcaccacctcaaggtgacacctccagatgaccccacgtgtgcaggacaacatggtgacctacatttgcatattaaaaggctagggtgggagggccacgtttttctcgggctgcatgaatgacctgcctggtcaaaccaataccctggtccctgtgcaaatcagacaccacctcctccagcctcccaatataaccgagtactgttctgccacacacggggctttttctctgttcggagcccccctttttctgtaccgcagggagcctttcttctttcttgcctattaaactttctgttccttaaaaccactcctgtgtgtccatatcgtttaactgacgtgacacaaaggaccccgatgtttctccagtcatcagagccatatcactttgagtccagaggaattattgttttcatttatctgaatttataatatagagtcaaattcctagtggttatcctctctcatccccatttttatagccttccttgaaaggaacaggtatatgaagaggagacaggtttcccttttgtgaatagtatatcccttagtatcttgattttttttggtgggagtcgggggagttaaacttacttagacctggtaaagggcagtatttgataaatgtcagctagtttagggttagggaattgagttgaatggagatagtcactgccaaatgtaaagcatgactggagagccagagtgatgaagccagggtccctttctccagatcctttgtaacagtgttatgtgatctcttctagaagatcgtgctgaaagataatgccaactcagaacctaggaaaccatccagtgggtttctgcagcttaggtgtttcaaatcctcatcagcaggttcgttttctctgcctcagtttgcttacaatgatgttctcagtagctgtaattgctgtctgtctttgaatacttaagcattttattttagctcacaggggtatgtatgcatttttcttttaccaagtgttagaactttgactctgcttttgtgggctctgggttagcaacttggttgtttagttgtaaaatgattagcagggaaaaccgtgtgtgtgtgtgtgtgtgtgtgtgtgtgtgtgtgtgtgtgtgtattttaagtttcttttgttgtcagagcacttcgaattttatgtggaaattctgtcagtttacttgattctccaccccacagttattgaacaggaaagtgtgaaggtaacgcgtcccataaccagccttcagaagaattacagctgctgtatctctgaactttcaagaagtttgtgcatcaattttcaaaaaattatgaaatccctgaagatagctgtgttctacatttggaaagatacaaaaactgaaccttctagcaggcagttttgcttgctggtgcttgagatagagccacacactggtctcagtggatttgtggagaaaagtaggtacagaaagttatttctaaataagaccaaaaaatccttttcttaagcagtgacaggtaaagaggttgtcttggctaaccttgaattgtgttgcccttgatagagacagttttatgatggggatggtagtgatgataaacttgttggaaatttgtccacttatggtaacctttgtggtagctgtcacagacaacttcatcctcacaggccctaaaattactataaaactaatagaatggaggagaaacaaaggacctgaataattagatgcttggataattgttctgtgttttcataacaagtgaaaaagagcagtgttagaagtacttaaacattccatgtaaggaacactgcctgaatttatattgtgattttagagcatcattcactgtttaaaaacaggcatattctaggtaatattttaaagacaaatagaaaacttaccttttcaagatggatataaagcttaaccttatcaaaattacaaaatgtaaagcatacgattgaaaaatattaatgcataggtttaaatattggtcatcattttagatgtctttcaaagtaggttgtctcttaaatattaaactgaacaaacattgaacttgttgtagagtttgtgctcaaggttaagtttcctggggtgatggatatttgataatatggataacaaaaagttcttattttaagaaatttagaaaatttttaggcaaagctagaaaataataccaataattctaccactcagaatgtaccactatcagaattttgtatctttcagtcatctgctcatctcttttctcctttgcttgtatgtgttccctctcccttaaaaaaatcagattttttattataatctgcattttcactcaacaatattgtagatctgtgtcataagttattcctctacagtgccttcagttattgtgtgctttgtgttggataactataccatctagtctttcatgtttcctggtactgactacataagggtgagagagagagagagagagagagagagagagagagagtgtgtgtgtgtgtgtgtgtgtgtgtgtgtgtgtattttttttctaccttaactaatgctttggacatcaacaggtagagctaaatccttgaaaccttccaagtggtggctttcagttattgctgaattggtttttagagatggaacaaattatattgtatggaaactttttttttttttttttgagacaaagtctcaccttgtcgcccaggctggagagcaatggcatgatcttggctcactgcaatctctgcctcccaggttcaagtgattctcttgcctcagcctcccaagtagttgggattacaggtgcttgccaccatgcccggctaatttttgtctttttactagagatggggtttcatcatgttggccaggcttgtctcgaactcctgacctcaggtgatccactcaccttggcctcccaaactactgggattacaggcataagccaccatacccagcctttttttcttctaggtaccagcttttatttatcagattggtataaatgttagaaagcgtgcaatgaaatgggcattttcacagtcgtggcagaaagtataattatctttgactttctagaaagcagtctggcattctagaaacttgcctaacctcttcccatttaggcaagatgaattctcactacccgtaggtggccaaccttgtccttgtgattccgtatcttccagaaagagaggtctagtctcagggaaaacccagattttcttggcttagcccacctgacagctaatcactggaaatgaggtgggccggtagagtcctttggtcaggttttgtgtcaagagaggaatgtggaaagatgggagggaggtagcaaaactggcctcaatggaactatgtaagttaacgtagaatgacaaaggaatgtttcttccagggaagaaattctagggaaggaagaaagtggaggggaaggcagcagttctcaaagttttgaggtcaggattcctttacactcttaaaagtatattgagggcccaaggagcttttctgtatataggttatatctattggtatttatcactaaaaattaaatcagaaatacttaaaatattccttaaaagctcaccaaattttgttatgaatgcttttatgaaaagaaaatttctaaacccaaagtagtacaatcttacaccttttgcaaatttcgttgatgtttgatatgtcatttgcacctgcattcaatttattgtgtgatatttgcttgaaaaaatgtgaacaaagaacaatctcatacagataggcattttagatccttatggatattttttattttttatttttttttatttttgagatggggtctttctctgtctcccaggctggaatgcagtgctatgatcacggctcactggagcctcattctctggggactcaggtgctcctcccacctcagcctccagagtagctgggactacaggtgtgtactactccacctagctaattttttgtattttttgtagatacagggttttgccataggtattcaaatagaaagttttgttgttgttttagtatataaagaaatataactttccatgttgaaaaaattttaaaaacctttttttaaattataaaactcataagcaaccattgttgagaaaattagtaaagtacagaaaaaagaaaaaaattaaagtctcccataatttctttacctaatataaccactattgacagttgacatgatggccattttctaccagtatatgttttttctttgctggtaaaatacataacccttacatatatgtttaaatagttgaggtcgtattctccataggtttatattcttttttttttttttttttgacgcggagtctcactttgtcgcccaggctggaatgcagtggcgtgatctcagctcactggaagctccacctcctgggttcacaccattctcctgcctcagcctccccagtagctgggactacaggcgcccgccaccattcccggctaattttttgtattttttagtagagatggggtttcaccatgttagccaggatggtctggatctcctgaccgcgtgatctgcccaccttggcctcccaaagtgctgggattacaggcgtgagccactgtgcccagcccttttatattcttttaaaaagtatttactgtattttcccatgatgtcatagtctttatagaaaaataacaatcattattttcagttgacatgattgtttacctaaaaatatccaaaggaaccaactgaaaaaaaacaatttttaagattactggttaaaagttcttttatataaaaatcaatagccttccccaatgttagctataatcacatagaacatatagtgatgaagtattttttcaggtatttcagcaaaaattaaatacctaggaataaacttagatgtgcagggcttttatcaaggacatgacaaaattttgctgagaggaatgaaagatttgcattctatgttcctgaatgagcagatttcatgttataaatatgttatcaccatgtcttcatattaatttataaatgtaatttctgctgggcacagtggctcatacctgtaatctgaacagtttgggaagctgaagtgggtagatgacaattagctgggtgtctgtggcacacacttgttccaactacttctgaggccgaggtgggaggatcacttgagcctgggaggcagaggttgcagtgagccgagatctgcctctgaactccagcctaggtgacagaataagaccctgtctcaaaaaaaaaaaaaaaaacacacaggaaaaaaaagggtgtatatatatacacattttatatttcatatatatatttatatataaattttgtatatatatgtatatatacaaatttcagtagaaattccagcagatttatttttggcatttgacaaaatgactctaaaatttgtttagaagagtaaataataaaaattaataaagtatagactctttcaaccagatattaaataaaatattgtggactagccctgggccagacagataaaggcaatgaaagtttagaaccagagtcatgcaaatgagaatttagtgtaaggaaaaggtggtgctttaacttagtagtgaaaagacagattattctgtaaatagttttaggagaactggccatttgaggaagtttgagtcttaactccaatttttgtcaaaataagttgtagttggtttaaacacatctattcttaaaaattagaacagaagaacatcgatttgaagatattttaagagttaaggctgaggctgggcacagtggttcacgcctgtaatcccagcactttcaaggccaagttgggaggattgcttgagcccaggagtttgagatcagcctgggcaacatagcaagactctctctctctagatatagatatacatataaatatacatatagagatacaaaaaaagagttaagttttgtatggagagccatgaagataagaggtgaaaattaaaggcttgatggacacatgtttacatctccagcaagggggttgatgggaaagactgatagacatagctccattactgctacctccttttaggaagttgcttctgaatatctaaagataacagttttataatagcagaaatgaggtttttttcagtgtctaaaacattacatgaaatacatacatacataaacatgttcaaaagttaaatgaagtaggatataaaattgggcctagtgtttaaaacaataaatatatttacatgaaggagaaaacaactcacttcccactcttacagcctctgccagtttatcatagcctagtttcttgagagaataagctacatgtcttcaccttttttcactgaactcattataatctggattctgccttcatctttgcgctaaaatttatctcctcgtttccaaatccagtggctcccctcttagtccacaaattgactcctctgcagtattttgttaatgttgattgttcctttgttgaaacattcctccgttcttaatgtccaccagcaaagagttggttaaataaaaattatagtgtacagttttataatagaatattctgttatagaccaaaaaaaatgcagccagtctttccataaaagcatgtgcaaacttctaagatgtattaagtaaaaaagtaaggcataaaatattgtgtataatctgacctctttagtatacagtgtaaaaaaatctatgtctgtgctagtttatacttacttttttctcccctggtggatacaggaaattgtgagtagtagaacacaattaaaaaagactgtgtggcttctgtgccaggacctgtgatagttgggtataaaagacaaaaaaggcatgtccctgtcctctgggaagggacatgatagtcgaatgggacttttatcagattgttttctcctgttttgatcttatcaccctgccttggtctcctccgatctcttcttccttgtcctacttctttcttctcttctcattctgtgctttctctgagtaatctttgactcccattacttaagtcatgacctgtgttccagggactcctaaatttgtattcatctccggagtttcaaacccatatatctgtctgtatatcatatatgttagggaatctcacttggagtgacatgggtgttcaaaatgatggtatttaaattttcatgtattcacctcctagcactctatcagccccatcatgtgtcccatcagtaattctccttgtcattgtgagtgggacaaaatgaaataatcaaactagtcacccatgcctcaacctgggaactgtcttagcgttcttttatatgctactgttctctgacctcccccccaaagtacgtttctaagacctgtccttctaaatgtctcttactattttccctgtgatctcagtttcttcttcccatccctcaaatgctttttgtgtgtgtgtggtgggggaagagagtaaaattgaaattcgtggaaaatgtactaccctgtctttcttcctttctttctttctctctttctctctctctctctttctttctttcaatgaagtctcgctcttgtcgcccaggctggagtacaatggcacaatctcggctcactgcaacctccatctcctgggttcaagtgattctcctgcctcaacctcctgagtagctgggattacaggcacctgccaccatgcccagctaatttttgtatttttagtagagatgaggtttcatcatgttcaccaggctggtctcgaactcctggccactaccctgtctttcttgttgcttggtatgactccactaccctgctccctctctccccctgcagcgggataatttaggaatcagagagactgaagggttgaggaggatatatattattattatttaggtgcaccggcccagtcaaatttaacatctaaaggactgagccctgaacaaagagtcaggttaccttttaaacattttatcgggtcgggggagatctgtgcagggggaggcatattacagaagcaagaaacaaagacagttattcagttgagacatgcattacattatttcttacttttcaaggaaaaacctgtttttcgactgagtttatctgtctagtgaccttgcagctgcacagctagagaatcagggtcttcacaatgcctgggagacgaggagagataaggttcactagcctcagaaaaacagacagttaatttttaaaggactccacctctttttctttcttagggggaattgggttttttttttttttataactgagtttttgcttacacattctttttattattattattatactttaagttctagggtacatttgcataacgttcaggtttgttacatatgtatacatgtgccatgttggtgtcctgcacccattaactcatcatttacattaggtatacctcccccctcccccccaccccacaacaggtccccgtgtgtgatgttccccatcctgtgtccaagtgttttcattgttcaattctgacctatgagtgagaacatgcagtgtttggttttctgtccttgagatagtttgctcagaatgatggtttccagcttcacccatgtccctacaaaggacatgaattcatccttatggctgcatggtattccatggtgtatatgtgccacattttcttaatccagtctatcattgatggacatttgggttggttccaagtctttgcttttgtgaatggtgccgcgataaacatacgtgtgcatatgtgtttatagcagcatgatttataatcctttgggtatatacccagtaatgggatggctgggtcaaacggtatttctagttctagatcctcgaggaatcaccacactgtcttccacgatggctgaactagtttacagccccaccaacagtgtaaaagtgttcctatttctccacatcctctccagcacctgttgtttcctgactttttaatggttgccattctaactggtctgagatggtgtctcattgtagttttgatttgcatttctctgatggccagtgatgatgagtgttttttcatgtgtctgttggctgcataaatgtcttcttttgagaagtgtctgttcatatccttcacccacttgttgatggggttgcttgatttttttcttgtaaatttgttttaagttctttgtagattctggatattagccttttgtcagaggggtagattgcaaaaattttctcccattctgtaggttgcctgttcactctgatggtagtttcacattctttaatttcttttaattcctgtttcaccccagcactcctgtagccccttctgtgccagaggtcagagtgtccaggtctgtgtccagatcaccctgcctcatcttcattatatacttagcacaaaacagagcacattgggtgcataatgaatccacactaggccttggcttccttttaagcatgaggatttttggtgtatcctaatttacggttcaaccttcctgtttccacttgcttcattgttcactttgggaaggcttattctttgcttcgttaacccattctaatcctgtgtcttcttactttgtcctttgtaaacctgcttctttctcttcatctcttttcttggtcagagacacccagaaaattgttcctgaccaagtgaagtgagttgccttattagatcccatttgagtcaccttatacattaaaaaacattttaaacaatgaaaaccacatttgtgcacatagtttaccttgtttatttccttaaacatgcttacaacacaatttggacgtaaacagggaaatttacagttattctttgcagtttcctagtgaatgattattttttagacagacacttaagagcctactaagtatcaagtgtttcacaggtttcatttaatctttactattctgggaaagttttcatttctttgttttacagatgagtagactcaaactcaaggaattagatatgatatccaaggtcatctagatttccaggctctgtctgctggatcacatttgcttttgtacttttaactatgactggaatatataattttataatccatgtgtaacaacactgcctgtgtgtggttttttttcttttttttttttgggtggcctcattaatgcagtaatgttctcttgtttgaagttgtaagtttctaagaaaacaaggtagcagtgcgaaattggacaatgtctggaacttccttcctctgcctttattcttgttgttccattaggtatcagttgtagtgattatagcccaagccatagtaactttcttaaactagaggctcctgaaaatatttcaaagagtttttttaaaaatctgtaagctgcagttgagcagttacaaacttttttatttcctactagattgattgcagtagtcataacattattgctgtcttctaagggctctttaacataatgcttatttactgaaatgtgttttgtagcttcatcagcaattgaagtggttgatatgtggactctgcaggttatataaccttcctaagcacctggatgttgagatgccagatcaaccactacccatgggtcagctaaagtaaaaattctctagtgttcaagagctaaaataaattgtctcaaacaaaagtcaaactaggatgattttttaaaaattattcaacttatttagaagttagtttttctgtacctgttaaattgtttgttctgttttagatactaaaaataaccttttcattctttggagctgctggtatttagtatggcaggcaaacaattgcccttttccctaacagcagctttttgttgtgaatattcctggtgtccataaatgttcttgcttttttcattgcttgtctttgctcattgacttgcctttacctagaaatgccgtctccttaagtctgtctgtgcttcttaaggacttgcccaaatgttatctcctgcaagcaacagaaatctccactagctcaccactacccctaacttcttcctggatttacctatttaggcatcagctattgactttttagtataatatgtgagaatttagctcttataccacccactttcccttcctctttagtcatataagtaatcactaattatcattaggactttgtaaagccaagttttgtagaatatttaggataggatatttctttccttggtgttgctttttgttttgcagtgtcttcctcataacagtaatttttaatttaaaaaattctgttgtagccctttctgtgagatctccttctcttccaaagcctttggctcctctgtgcccattttggcaggttgttcttcgggttggctgtgcacatgtcatcttgaggtttttctcatctgctcgcctagagtacatccattgtttcctggatcccatgtcatcttctttggctttccctttgtcattttacctgactatgtcctcaagtaaaaccctaagaaagcatggagtggtatattttctgatctctagcttctgaaaaaatacaatccagtgtttgggttttggagccagtctgagataggtttgaatcttggttctactacttattagctgtatgcccttgggcagattccctaattgctctatgcatcaatttccatttgcaaaatgggggaaccagtaatagtattagtacctatgtttctagggagctgtgaggattaaatgagttggtacatgtaaaccatttagaacagtgcctggtgcttagcccatccccatcactattcacttttgtcatagtctaccctcacacttgattgatagtttggttgattatgtatttctaggttgaggataattttaccttagaatttcaaagtctgtgctgttgtcttctaaccagtcatggtggtgaggcctcatgtcaccctgagtttcactcattcatgcatgactttctctctggaagcttttaggagtttgtcttttccttggtgagctgaaatagcacaacattgtacttagtgtgtgtcttttttcattcactgtgctgggtacaccaaatggataggcctatggatcgtctctttcaaagttggaatcttgaatcttgtcatatttttgttaactttctcctttccattttatttgttcattttgaagtgtctgttaattggattttagtcctcttgtttgagtcttgtatctcacgtcatttctaattttttttaaattttaagttctggaatatttttcttattttttgacttttaggaaattttatttggacagtcataactttaagttttgttttggttatttattgttgcttaaccaattttcccaaaacttaatggcataaaactacacatttgtctatctgtcactactgtatgggctaactgggggtagctggacagtttttctgctggtctcatttggcatctctcactgtgcggttagacggtgtcagagactggtcatctggatgctcagctgcagtggaatgtctgagacggctgcttcacccacaggtctgctgccttggtgtttcttcttgtggccttctcctctgcatagcgtctcatcctctcaggcctctttgtgtggtttctctttctccaagaggatagtcagtacttattttggctactagaagcacagaagtggagctgccaggtgttcttaaggcttagacctggaacaggtccagtgtcatttctaccaaattctataggttaaagtgagtcttgaggccaacccagattcactgtgggatgggcctgtccagggacatgataacaggaggttaggctcattggggaccaactcccaagatgaaccctgagttctaagaactttttcttctctgattattccatattcatattctaattttgttttattcatgtaatatattcacaagtgtccttatgaagtgattttgatgctcttttgtcttctccctagcatctctttgttctttaataaatttttttcttagtttattttggtcttatttttctttttaaaacctttccttaaatatctattctatgttgcttatcatttgtagtctttttttttttttttgagacggagtttcgctcttgttgcccaggatggagtgcgatggcgtgatcttggctcaccgcaacctttgcctcctggggtcaagcgattctcctgcctcagcctcctgagtagctgggattacaggcatgtgccaccacacctggctaatttttgtatttttagtacagaaggggtttctccatgttggtcaggctggtttcgaattcctgacctcaggtgatccacccacctcggcctcccaaagtgctgggattaaaggcgtgagccactgtgcctggcctgtattcttttttttttttaaattcccttttttgttcattcatatttgagagaggtactgaaagactgggaggctgggtgtggtggctcacacctacaatctcagtgctttcggagattgacgtgggaggatcacttgagcccaggagctcaagagtagtttgggcaatattatgagaccccatctttacaaaaaataaattaaaaaaaaaaaagccaggtgtggtgacacccacctgtagtcccagctacttgggaggctgaggcaggaggatcgcttgagcccaggatgttgaggctaaagtgagttgtgatcatgctgctgcattcctgcattccagcctgggtgaaagagcaagatcctttctcaaataaataaataaataaataaaataaatacaaataaaaaaataaagaattgattgggagttctgcatggcgaagacttggcaactgatagcttttaggggggaatgtatgctgattcctaattgttatcctctacccctctatcttatctcccagtgcaatcataaatgatggctggaactactccattcctctggaggtgaaatctacattctcttgtctgaggtagatatgtttgcttgggttctgcttaaggagatggaggagagcagtgtgtttcagggcctggaaaaggtgttctctatataggcttttggttaatctctgttttcagtcttgcctgtcagtcccactctcgggggtacctggtgtctgagtctagaacctttccaggttgctgtgggacaaattagcttccttgtttttggtatcccccaacctccacttttgtttgcttgctccattaattaaccattttccatttactgtcattttctaatggaggtgaattctcttctgtgggtaaccccatttcttttttttgtaattgtttgtttatatattgtttattcttcactgtatttctagtggagcctcaggacaaagagcagatggtggaaatatgtgttcagtgttcagtttttttctgtaagacatctgcaacttgtgtttttcactgaatatcacgtggacttaatgcatatagagctaccttgtttttcttgattgtgcctacaattctatggagaaatataatttgtgaattacctgatgaaattttcctaattttgaatcatccttgcattcctataataaacactgttagaatggctatggtaatattttatttttgcatttttacttctttataaaataagattatagttttgtttgtttcttttaaggctcttatttcagtatcaagggtatgcagggctaactcgggaagctttacatcttttttctaagacctaggatgtagatctagtttacacagtaattttcaactgcaggaatattttgcctcccatgggacatttggaaatatctggagacatttttgtggtcacaactggtcacggtcgggaggtcttattggcattccgtgggtagaggggatgttactaaatgtcccacaacacaccaggagaaccctcacaaagaattgtctggcccaagatatcaatattgctgaggctgacaaaccctggtttaaataaatgtccaatttggaggatgagtctgtctttttccttcttctgcgtattggtctccagattttccatttcttcagttagttttcgtaactgtagattcttaaaagaaatgaacacttctcccatacttctaaggtgttgtaaagatgtgtaaagttttcactttttgcatcatattcacatgtggctatatgcccttttgtcttcaaagttttctttatcttgatcacttatcagaggcgtgactgttttattatcttagtcttttgaaagaatcctcccttagttttattttttaaatttagtgggttgttttcacattttccttgtgtcttaattatttcccctttttgtttattttgctttttctagtttagtggatcaatgtaatttaaactgctttttaaacaaacctgtaatggtatacattttctttgggtgctgtttgactttattgcacaagttttaaaatctattttctaaatagtttgtattttccaagtcattttattgcatcctctgttcacattgctcttactattaaaactttttatttgcccggcatggtggcttatgcctgtaatcccagcactttgggaggccaaggcaggtgaatgacctgagattgggagttcgagaccagcctgatcaacatggagagagcccgtctctactaaaagtacaaaaattagctgggcatggtggtgcatgcctgtaatcccagctacttgggaggctgaggcaggagaatcgcttgaacccaggagacagaggttgcagtgagctgagatcacgccactgcactccagcctgggcaacaagagtgaaattccacctcaaaaaaaaaaaaaaaaaaaaaaagacatgtattgaaattatgtaaaacataagcttagtgtaacatatagttagagcgagtacttgggaactaatacctagccagcaccaaggtgaagagaaggcacattgcttgcactacagaaaccttctgcaggctgcttcctgatcaccatgcctctgtacgctcatcttgccttatatttctctagtgttatcactcatatatgcatccttcaacaatacggtgtagtgttgcctattgtttgaacttttgaaaatcatactatatgtattttttcatatctttgttgtgctcaacattgtgtgtgaaatttgttcccattgtgtgtagttatagttcttttgcattgctgtatttactccattgtttgaatataccataccatttatccccttgactagatacagacatgtgggttgtttccagtgttattaggaacagtgattgctgctgtggtcattcttgtctgtatttcatggtatccttgtgccagcatttctctggggcacatacttaggagttggatgactgaggcatgaggatcaatttcttcttttacccaagagttatctagaaaaaaaaagcattttcaggtggcttttgaggtgtttttagtgcatcagtgtggtcagagaatatggcctgtgacctttcagcgagattatcagcaatcatttagacttcactattggtgttactgttgcctttgcttattgctacttcttgtatcatgtctcctgctccctgcccctcgagtatatccctgaataatatcctgggtttttgtttttttttttttcctagaaagggtttgtggggatgtgtatggagtgtgttccatgaacttgctgtctgttatcatttgttcaacaaatatttgactctgtataaagtactccatccatatcagtgtggagaatccagaggcaaacatacacagatacgcttcctgtcttgacggagctagatatagaattctgaggtcataattgagtttctttccaggtctttatacttttatgttctgatatttattgttgtagatgaaaagtctgatgcctatctgattcttagttctttctgatagttagtatgattttctgtgtaactgtaaagtgtgggggttttacttctttttttttttttgagacaagaatctcgctctgtcagccaggctggagtgcagtggtgcgatcttggatcactgcaacctccacctctcaggttcaaatgatactcccgcctcagcctcctgagtagctgggactacaggcatgtaccaccatgcccaactaaattttgtattattagtagagatagggtttcaccatgttagccaggatggtctcgatctgctgacctcgtgatccacccgccttgatctctcaaagtgctggaattacagatgtgagccaccttaatgttttgctgagtcacgtcattgtgtcctggcccttctgcaactggtgtgttgttttgttttgttttttttggtttagaggtcttatttttacctcctagaattgtcttttgcatagtaatctgttttgtattttgtggatacagtatcttctcaattactgctaaagattccaattaggttttaaaattctgcttatttccttcattagcagtgcttcaggtcattcgtgcttctttgacttggcaccttcctttcaggttgctaattttcttcaactctctgataatacatggttatctgttcatttatagatgaggtatacctttgatcagtatgagttgttatgagtgtcttcagaattgttactcttttctgctgtggcctccccctcctggtttgcagacctgtgctcttcctgtggcatgagggtggggaggtgctggccagtgagctttccagattttgagctaaaaggaagaggcagagtctgttataagattttgctgctgcattgagttatattaaaaaaacattctgtcttttctctctggttttgtcactgatagagaccatcaagacaggcttcctattaccagagtgatccttaccaactatagttgggacaagtacagtgaggaatgatccttcaaacagaagtggcccctccattatttggattgtgtttgtggctttctcgcgcccagcagtctgattccatctgctttgtatcttctagcatgtccttatagttttggttcactaagggtattctttttgtatttgttgttttgctgctgctgcagctgacttactctcttttataaaattctgtcatttcagtggggttttagaaagaggaccaggtcacatcttgaaatgaaattaatcttaggatttcacagccctaactcactttttgttttgattaaattacttcccctttttgacgggataggggctcagctttctcatgtgtaaaatgaaggctagtaactgggctagtggtgacagacccagatgcatgtgagaatcacctcagagagattttgcaaaagagattctttgggtaggctttgaaattagcatttcaaaaatgctctttcaaccattgatgcaaccaaattttttgggactttgaggctaggtatatattctttagatacccagaataattggctttggaatataagaatttagggaaatgaagaaggggtgaattacattttggaagcttctgcttagatactgctgagacctttgttggtcttgatttctggatcctagtttctagatcttttacatattctgagttctaatctgaactggcctttatggttaaagctgcatatatatactgtgtcctggccaggaagcttgtcttttgacctttgcccgaactgggtacgaaagcccctcctaaaaattcattagattcatttctgaacttgataattgtaatttgtgttaattggtaaattgtgtcttgtagagagatattcgatagtaaattacatgtttttaaaaagacaatttgctttatagtgaggtggtaatcaattcataactcttagttttggggagcgtctattgtaagtaacacatctgacctcttaaaatgtaaggaaattgaatttatgtaatgattcaggcttttcaaagttaaaaaggtagctgttttgaggaactgatagtttggaatatttattttaaacaaaataagcctttgatcttatgcacatagccgtacaagtaaaatgttttcttattttaaattagattatgttttagaatttttttcagttttgctttatatttgactgattgcttttctttattcctaaggcatccattaagttgaattgttcaaaattgtttcatttttaaaagctgagaactgttgtttgtcaaatcaaagttggatttaaaaatgcatattttaattttaataagctctttggtagtgggactgcagtgacagatggttgggagtttgtccctaaagctgtgacaccaatcttctaatgtgcatatttgttctgtgtagttctggcagattctttctctatttcagaatgggacaacagaagaagtgacttcaaaagaagacgaagaggaagagatggatgaagtgggtattttatataagaataacattatggccaggcgaggtgactcatgcctgtaaccccagcactatgggaggccatggtgggtggatcacctgaggacaggagtttgagaccagcctggccaacatggcgaaactctgtctctattaaaagtacaaaaattagccgggcatggtggtaggcacatgtaatctcagctactccggaggctgaggcaggagaattgcttgaatccaggaggtggaggttgcagtgagccaagatcgtgccactgcactcctgcctgagtgacgagcaagactcttgtctcaaaaaaaaaaccaaaaaaaatcataaaatatcttcagttttggacatttgagtaattctctaatctcctttataaataactattaatatggaataattgaaagcacgtcgtatttggaatggaatgtaatttataaattctggctttacctctaactcatgatatgccttcgggcaaattgttttatctgaattcttggatttgattttctggaaaacaaaagctcttaacttttagcactaaaattatatttaatactaatcagtacttaacctgtatttggttattttttggaagagaaactactgagtttaaaaaattttatgtttgcataaaaggagaatttcagaatattttagagactacttgccagaagtagtgaaactgtctcttgctgaaaaatcattcaaagaaatttgtcttagtctgttttatagtattgtaacagaataacagagagtgagtaatttatgaagaacagtcatttattttctgacagttctggagtctgggaaatccaagatgaaaatatcaacatttggtgtctcaggaccttcttgtttcatcctcacatggtagcaggcagaagggcaggagagcaagctagtccaatgtgtgaagcctcattcataagggccttaatcccatgaaggagaaaggagccctcttggcctaatcatctcttaaaagtcctacctcttaatatcatcacattggcaacacttgaattttggagggaatacattcaaacagtagcaaatttagtagagcaaattccaaagacattgagcctaggccagctgtcagtcatgggtataattttagatgttttcaggctctgaagctttgcacttaaatttgaacttcagaacaaagatctgtgtctctgcattgaccaaatagaatgtatgtgaattccatggtgttgattgttttaaaagatttttttctgtttggggtcttataattaatttaggctttcattttcttggtttggaaattattaatctaaaatgtactttagagtgcttcggaactaaaaaggtagtgttgtaggcttgtttttgtttgttttttgagacagggtttcactgtcacccaggctggagtgcagtagcgccggcatggctcactgtaaccttgaactcctgggttcaagcgatcctcctgagtagctgggactacaggccggtgccccacgtccagctaatttttttttatttttttgtagagtttgagtctcactctgttgcccaggctggtcttgaactcctggcctcaagtgatccaccacctcggcctcccaaagtgctgggattacaggtgtgtgccactgtgcctggctgtaggcttgttttatgagtctgggagtaaaatacttcttaaaattgtccaattaggatgagagtctgttttaatgtttttatgcagtttagcttaggtggaataaactgcatgaaaacattaaaccttttccatgggtcaggcagccattgtactaaagttcatgaaccctttcattttcccttgacaagataataaacaagggaccgcaactttgagggaaatctagaaaggtaggagactggactttggagttgtcagattaggacaggtgaaaagcagatattctaggctcctaaaataatgtgggaacaggcccagagcaactttggacatggtgtgtttgggtgcattggatgcttttgagaaggaaggttgatgtgttgaagtcatggaaagcaagattgtccagaaaagacagatggacagaagtcttgaatttgagacaggcatgtttctatttggtatgtttgttgataagaaggccttaagcagggaatggtgtgctgagaatattgttttagaaagatatgttgaattctgtttgggatgtgctgattaatacttaggtggagaagttttgtggatgggaacatgactgaggttgaaggtacaggtggaaatacaggccaaaggcatttgtgagcattgtgggaaaacaagtgtgggtggaagatcagggctgaaaggtgcacacagggagaagggagctccatgaagtacatgggcagagtttgagtgaaggtagtcagtaatctggtctagaaattggtgaattaagcggcttgggaaaaaagtcgagataaatataaactacccctttagagattttggcaattgaagtagaaatataaggtaattgaaaaaagttaggatttaaacaattctgcatatatttgcgtatgtgtaagaacagatagtatgggaagggagggagcagaatgatgtgaataaagatgttgttctgcagggtattattcaaattcttttgaaattattattagtatttgagatagggtcactatcacccagggtggagtgcagtggcatgatcatagcttactgcagcctcgaactcctgggaccaaacagtgcttctatttcagcctcctgagcacctgacatcaaattctttttctaacttatttttaagttattaacatcaataggtgcttactacataaaaccataaacttggaaatcaggggaaagcaccaaatgtctccagagataacaactaaaattaattgaaattaacatttcaatgtaagttgttctggtctttttctgtgcttatttcagcataattgaaattctctctattcctttgtgtaatccatttttcatttcaaagtttttcgatacaggagaaattatgccgtgttgatatttcagtggctgcttaatagttcatggaattgagttaactgttttgctatttttgcacatgcagattttgtgtttgtttttgtggttgcaaggttgaaataggtattcttatgcctaaatttgtgtttacctcttagactagtttcttgtaatacaattctagaagtcgagtttctggaacaaactatgaacagttaaggttcttgacacctgctgctaaactgtttcaaaggttcctcttaggagatttaaaagatggcttggccaggcgtggtgtctcacgctggtaatcccagcactttgggaggctgaggtgggcagatcacttgacgtcataagtttgagaccagcctggccaacatgttgaaaccctgtctctactaaaaatacaaagaaattagctgggcgtggtggtgtacgtctgtaatcccagctactcaggagactgaggcatgagaatcacttgaacctgggaggcagaggttgcagtgagcagagatcgcgccactctactcctgcctgagtgacagagtgagactctatcttacaaaaataaaataaaataaataaagaagtaaataaataaatgatggcttatttcataatagttgtgactttgtaaagcttttaaatctgctttccccagagtctagcttttaaataaaatacaggatataaaaggtgggagcctcttgaatggaatgtgggggctttttctttctccccataggatagatatattctgtttcctgtcccccaccaagtcaagaataatttaagttttggcataagaaactgctgaaggaaaatgggttgaatcggctaatatttttcttctttttgcaggatatagaagacttagatcactatgagatgaaagaagagcctattagtgagaagaagttggaggatgaaggaactgaaaaagaaaattgggcaatattagagaaaattaggaagactgaaaggcaaggccatttaaatgtgtaagtgtgtataaatatctggactttttggttaagtaattatagttaataccaggcaattcatgaacatgccgatgtcagctgctctcctcctccattcctgccttagtggcggattcagtcatgtgtttattggttttgagacagggtcttgctctgtcgcctgggctagagagcagtagcacaatcatagttcactgtagcctttatctcccaggctgcagtggtcctcctacctcagcctcccaagtgtctcagattatagtcatgtgccaccacaccaggctaatttttttgatttttagtaaagatgaggtctcactgtgttgaccatgctggtcttgaacacctgagttcaagcagtcctgctaccttggcctgcccaagtgctgggattacagacatgagccaccatgcctagccacgctcatatgctttgttgccgaaggttatctttctcatctatgaatagccacgttttaccctgttcatctgctcttcacatcctggaaccacctgctgatccctgtatatgcccctttccagcttgtctatgctgtgttctctgcttaccttctttctgtggcatctgtaaattcaagttcattctttcctacaaaacacaactcaaattatttctccttcatgaagctgactttgacccatcctgctctgaccaaaccaaaagtaatgtttctcttttgacttaacatctcttttatgtgaagcggcaggatgggaaaggaacactgagtttggtgacagacacaccttttatggtttcactttgctcaaccctaaaatatggagagacagtacatatcttttggatggttgctatgaaaaataaattaaaatgatgcatgtatatacataaaatgcttagacagagtagggaaacatcaaatgattgtctgaacagttactgcttcctgccttgtattagagctatttaccaactccacaacatccgaggaccagttactttgtcttgggcacaggttctccaaaacagggaatgaattgttaggcaagcaaatgccagatgttgaaatcagataactctccctccttcaatcttatttgtatattaatttaattggtaatttttcatacagcaaagaaatttagttaatctccatatcttgattatttaaaaaactaagattgtagcatttgaattaatgttactgtacttcctgtgtcttgtgatcaattccagtttgagttatcttcaaaacaagtaaaaattataattttgcatgaccgatactatactaaatactttatactaataaagatcttttcatttagtcatcatagccactgtgtgaaataggtgctgtttatactttagagatatgaaaaacttttcatattttatagatatgaaatgagttcaggtttacatagctaggaggtaatatttttataaacttgatttttttcccccttcaaagtctagtgcagtctttaaaacctctagtttcacatgaccaaaaagtagttccatttctgtttagtcttaggataagatatggatgtgttttcatctttagagaagtccctgcactgaaaaactgaaaccagttgcatgtaggcacacgtggttctcagtgtcttaatgtgtgaactagaccatctgtgtaatattcttgcttgtagtcttatgaatggaagcctattttacttaatattgtgtcaccttgagtattttcaaaaattgctggggtttggaatagactcatactgaattctatgctatcgtggagtccatggttatctgaacatgttggctagagttttttaggtgataagaaaaaggaaatgaaccagacttgtgtctagttttatattctcttgaaacttcataacgcttcatttaattgtcttttttttttttttttttttttacttcttaaattgttgagtggtgatccatttttattgtaatctttctcttttttcttttttttttcttttgagatggagtcttgctctgtggcccaggccagagttcagtggcaccatctcagctcactactacctccacctcccaggttcaagtgattatcttgcctcaacttcccgagtagctgggactacaggcacatgcaaccatgcccggccaacttttgtattttttaaatcagagatggggtttcatgctgatgaccaggctggtttcaaactcttggcctcaagtgatccacctgcctcggcctcccaaagtgctgggattataggtgtgaaccactgtgcctggctactgtaatcttttagagcaggttgaaataccttaaatctttaaattagttggctcagtagaccctggtaaacagcggcttttgtgtttccggctgaagtgtctgggtcagtgcaagcttgcaagcttcagatagacttatacatatacagggctcagggacatatacagatcacagagttataagacaggtaaggatctctaaatcccttctcttattgttcttttgttcttttctgttgtcagattataaatgtcatttcttaaagctggacagaaatggaaatgtttactagctttattttgtgaaactcaaatgcaatcaagttccaaaagatgtagggggtaagataggatgagtttgcttgtttttggatttaaagaaattgtttttataggtccgttggaatttttttggtcatcctcctgatagagtgaacatttacatgatttttatcttctggcaaaaagcttgagcaatattgcttgataagtaaataagagtaatacatttcattatacagagaatgattgccaagttgatttttgtgatttttccccccagttttgaaagcaacataatcaactcttattgtggaggtagttatgttattactttaaaaatatataggtggagtacacctgttgtcctagctactagaggtggtgggaagctgaggcaggaagatcttttgagcttggggaagtcaaggctgcagtgagctgtgattgcaccattatattccagcctgggtgacagagtgagacaccctgtatcataaaacaaaaacaagggggagtggagggtgggatacatattgtatatgtatatataggacagttgtagaaaaataccgattttttagtgatttaacttttgacggttccgtccatggcaaatttttctccttgaacaccttggctaataatacaagtttaggaaagcatattaaactgtgtttgaattcttgagaaaattatatacatatgactgttttcctttagaatgactccaaactctgaacccccttattagattagatttagggtattgtgatccctttgggacatttattctaaaggagctggaaactatagtggcctctatttttcctggggatatagagcagcttaagatctcctctttctggaacttatcctaggtgctctattttagctttcagattggttcatttttgagttagttaaaataataataataataataatctttttgtttgaattgttttttgttttggaattctcaaggttgaccctgatagtcctttgcacagtgatctttagatcttaaaaagaagcgataggagacattttgcttatctttcaaggtaagaaaatggttatgagactctatatccttctaatgggggtgtgtatttgtacaagtgttttggaaaacggtttgggaaagtggaagatactcacaccctatggttcaggaatctcgtggatatatactccacaagaaatgagtacataggtgccaggagacacaggaatgttcagagcagcatcgtttataatagccccaaacagaaaataacccaaatgttcattccaataaaatggagaattgtggtattcataaaatggcttacagtcatgtgggacaagatgagcgaatcttgaacactatgttaagcaaaagagaccagacccccaaaacctattttgtacaatttcctctatatagagttcaaaaataggcaaaactaatgttggttagggcatacattcttagcggaggcaatatcgcctgcagtggagtgaaaattggtccttagagtgaaagaaaatctgacctattatactggtctgctgccctccaaacggccatagaacataaatgaaaagaaaactgagaaacacttctttatgggttcatacttgggcagtaaaactatcaagaaaaaagaggtgattagacacagggtagagtaaggagtccatctaggtgggaggtagggaggtgtgaactgaaaggtacatctgtgggcttcttggatactggctgtaatatatttctggaccaggttggtggttacatgggcaaataatttaaaataacttgttaaggtctaccttaaggtatcttttgtgtacttttctgaatgtgttatatttaataaagtacttttaagataccaaaaataaaggttacaaaagaataacaatggaatctagaaaaaatgttaatgatctaatatggaatctagacaagatgtaatggcttaaaatctatggctatatgaagtattttgatgaaaaaaacaaagacataaaggaatactttgttgtacttactctaaggatggtagtagttttctaaaagcttacttagctttttcatgtgtatatttttccttggggatatatcttatgattgaactttcttgaaatgaccctaatgttagtattttctctcaattttgttatcatagaaactgttgtggttgtcaactgggttgtcttcctaaagtatgaatccagtataggctgaagttgctaatggctacttctttacggattcatatgggtgaacgaatgaagcactcaggcctacaacaaaaaaaacacacacacacaaaaaacaggaagataccatttttaaaaaaaaacattaaatcatatgaacatatgcacaacaccaaactttaaagaaatagaacctttggctgggcatggtggctcacgcctgtaatcccagcacttgggaggccaaggcaggtggatcacctgaggacaggagtttgagaccagcccagccaagatggtgaaaccccatctctactaaaaatacaaaaattagccaggcgtggtggcaggtgcctgtaatcccagctacttgggaggctgaggtgggagaatcacttgaacctaggaggcagaggttgcagtgagccaagattgcaccattgcactcaacagcctgggtgactagagtgaaactccatctcaaaaaataaaaataaaaaagaaatagaaccttatcagtacctgtagcaccctctgtgcccctcccttgtcatgtcctctttgggaggtatcttgaagggaatgtgacatcttggccaggaaactggaggatttgtgactgcaggtggtgttttcattattttttcctgctgtagttagaacttcagggaggggatgatctgggaggtaaatggctgaaatgctattggatttgtgtttgtggcccatggctcctgataccagaaagaagggccttttctggggttggagtatttcttaagaggcctgggaagaatgtgattgccttgagctaactgaccttctgaagaggaccttaaactgaattgccaagttattagtattgggattcacagactttggagaatagcaggtatgactcagaaagatttacaggaaagagccagaacaatatgtttatggcctctgatgtccgcagtgacaacttgagagtcgtgaataataagcaaaattgaacttgagataaagtataacacaaagatgggagtgactgcaggagggaatgtgccctggtcagcaacttggtaaatccaacttgctgtacttttaaggaagtcgttttcagatgttacaggcaacatcagagttactgaattgaattctgaggtagtactttaagaaaggtctacttagataaggttaggttcatttagagaataatagccaggattgggaagagattcttttccatgtcctaggatagctggtgaaattatggatttggagaggaaaacatgggggttctggttcatgatagattgtcttcaactatttgaaggagtatgtatatggaagcattagtttttatttgtttttggtgaagacagggcataaaactagaactaataagtcaaattacaaagaggtgattttcaactcaatgtaaggaagtgacttgtaactatttagacccatctggtgatgtagtctttgaaaactagaatgttcttcatctttaagaataacttagaaggctgagatgttaaatgggaagtcagataacttcatgagatccttgtagagcctgagagtctcgttctgagttaaaatatactaaggtaactcaaacttaattttaccagtcaccctcaacctttattttcccctccctgaagaactctttttatttctgtaaaatcttgattcctgagttccagggtacagagcttatggaatagagtccccaggttttgatgtaggatcctctttctcctgtctgaaaatatcctttagtatttcccttagtgtgagtctgcagatagaaaaaatccttattttttatttcattattaaagagtatcttcattgagcgtaagtctctagattggcagtttccatctttcagcaccttgcagatatcattctgttatgctagcttccattgtttctcctgaagtgtttatggtggttaaatcttgtggagtctttgatcagttctggaaaattctccacaaccatatcttcagctcttgcttctgtcccattcttttttttcttacagggctctacatatatgataaacttttcaatatattgtcttattttctcaattttctacctttttgtctttctgacctttttccggtttactgaatctgtcttctgctaggttactgctgtggttaagcttatccattatgttattaatttcagttttggtagttctaaattgcagaatttcatatggttcattttataatttgcatttctctgccaggttttcagtcttgtcctgtctttccttgtctttcagcagagttattttgaagtgtgtctgctaactctgttatctcaatcccttgtggttttgtgtctgttgtttgcttctcttgttttctgttatgtcatctttaagtctcatgtggctttttatttttagtgatagacattatatatgaaaaattgcagagctaatttgaagccttggatgatattcttctccagagaggatttacatttcccctgctagggtcttggaaattcacaatcagggattgagacgattaaagctggccatcattccctgttggggcattttgcagtttgttcttcagattcccaacctaaggagtgggagacttagcagggcctctcctcagtggatgctgagctccaatgtttaactccctgtgagctctgtgaggctgtgagttctagctcagcttgttaacctcttcttctctgctgtcattggaagaaaacccaagggggagaaaagaagaccctgttctctgctattcccttttctcagccctgtaatcattacattttgtccatctttctagttctcagtgagaggattgatctaagttacctactctatcattattggaatggttcctttatatagttctagtgaagtgaaaccccttcatatgtttcataagtttaccataacactgttctgtttgggcctcattttaacttcatttttatttgctttggttttcatttcattttttctgtactaattttacttttatgactctcacccattatctgataataaatgtacatattcttttatagacttttaaaatcttctaaatggtatatagtattaacgatgttcttaaaattaattaaacttgcttatttgctttttaggataactttccatttgagcctccatttgtttgagtggtattacctgttctctcaggagcataagtttaagtgattactttaaatgtttttttttttttttttttttttttagtttaaaaaaattttttgtagagatgaggtctcactatgttgctctggctgttcttgaactcctgggctcaagtgatcctcccaccttgccctcccaaggtgctgggatgacaggcatgagctgctgtgcctgggctacgtttttttttttaatatcgcgtgcaccagaatcatttggagagctagtcccagggtttctgattaagtaggcctgtggtgttgcctgagcatttacgtttttaagaagttcccaggtgaaactgatactgttgttctggggcctacatctggaaccactggttataaagcattatgttgttgataggtagagattttagtgttatatatatgcatatatacacatatatacacacacacacatatttatacatacacacacacatatatatattcatacatacttttttatcataaaaaccaaaggtttttcaaatgtaaattgtgattgaaggtttagagaatgttatgattacagagtggtccccccacatacctgtaatcctaattagtacttctaggaataatcatgggaaatcccatggacctatggagctggctaattacttctagaggtgatagttgcagtgtagtagaatcaaatggtaattgtcatgcagttttactgaaatttgtattgcttcttttttgtgattggaagtcttacagaagtggggaaaagatcacagtttgctaggttagttatgaaatgttctgtagaccctcaaagtatgagcaatttaaagtaacttgaggattttcaaacactcagctgactaattccattatgtgacataatccacattatggtgattaaaatctaaatatctccagcccttactttgatcatttctatggttgagatagtaatagttgcatttagggtaaaaatatgagtgactacttcacacttcagaactttctccagaagagctttgttgctacagttatttttagttgtatttgctttacatacttatgtatgtgttttgggggctaagatcctgttaagaatcattctgcataatcagaatacatattaactatggtgctgatactacggaatagttgtctggacatgatatccatgtgtaaaagttcagagaaacaagaagtgtgggtttaaaaaaaaaaaaaccttagtattacatgtggatgtgctgagctcattttgagtttccccacacagtaaaggaatattggttttattatttaattacttaattttattgagacagggtctttgtctgttgccccaggctggagtgagtggtgcaatcacagctcactgcaacctctgcctcccgggctcaagccatcctgccacctcagcctcctgagaagctgggactgcaggcatatgccagcacaccaagctaatttttgtatttttgatagagacagggtttcaccatgttgctcatgttggtctcgaactcccaggctaaagcgatccaccccactgagactgacaaagtattaggattatgggtctgagccactttgcccagcccaatgttgtttgttaaaattttttatttatttacttatcttttgcttttctgttttaatttttaaatttctattttttcaatattgtgttttaagagtctacttacccgacgcctgcagtctaatctttgccatatcttcccaaatgttctgtgagtgctaatatagtggtatggtaatagatatttgttttgtggagattgcaaggttttggggaaccaggttcaaaatgtcttttaccaaaggacttcttggagccttaatgccattttctgtttttcccaaatttgtttattagtgttcctgacagcatctcagaggatggtgtcctctggcttactctctgggaaatgctgctctgttggaaatccggagttctgagtgatccccatgcgttttctgctgcagagcaggacatgctgaagtgattccttcgtgagcagatgttagaggtctccctttgacagcttgttacaaagttgatcacgaatatactattacggtgagtggaagtcccaggttgggtgtgaagcagagttgtttagaattgtgtactattttgttacctttaaagcttctctaggctgttttggttttggcagtaaaattgctataaaaagtacttctcttggcatacaacctaatggtcagttttggaagttcagtgttaagtaacccagccaaatacttacgtatacaaaataaacacaagactgaaaaatagtaaatgtttaacctttgctcactacagcaggctttttactagccaccaagccatagttcttttgtttttcatagttgaatgttaaaatgtctttttaatgaagcccttactgattggggagaaaggacataagtattgtgctttagttttatgtgctggtttataaaattgtgtatgttgactcaatatccccataagcatagggaaaggaaaacgggtcatgttttgttcagaatcttatttgagaaaaaaaaagatcaaagaaaagatttggataaaaatctgcaaattcaggataaatgtatgaaaacattttaaaatgtgattatgaaatagaccagtatagcttttcaacattttgttgtaagaatcccaagaatgtaagtttatgatcttagtataccacctagaatcgagacaaatacatgaagttatgaatcatgccattttcagttttaaaatctgttacatagtttcttcattgattcttttttgccacagtgtgttatggtcctcattatttggatgaataatttgaataataagtcagcttgtgacttagccaaataaatcttctgattcctagtaaagtgtttttcattatacgaaatgccagctatgtaagaggagattaaaagtactaagaactgtaagtactgcattgattatcatatgctaaccatgggccaggcacggtggcacacacctataatcccagcactttgggaggctgaggcgggtggatcacttgaggtcaggagttcaagaccagcctggccaagatggtgaaacccctgtctctaccaaaaatacaaaaaatttgccagatgtggtggtgcatactggtaatcccagctactcaggaggctgagtcaggagaatcgcttgaactcgggaggcagaggttgcagtgagctgagatcgtgccactgcgctccagcctgggtgacaaagataaactccatctgaacaaaaaagaaaaagaaaagctaagcatggacttaatttctctgagatttaaagctgcaaagagttgctcttcatgaagtagatgggatctcagctgggcagtgaaatgtgagtggggtttggtcagctggtggaggttgcaggaaaattatttacataggtgaagagtaagcgcaatcaggtatctaggaaagaatgaggggttcagagtatacgaaaccaatttgagctataacacaaggagggtaggattcatgtagaagagttgtaggaaatattgctgatgtaatattttgtactcaaacagttctgtggattggtgacagattttttttttcaggtaagtaaactattacccctggatattcatctttctgtgtagctggttgagaaacaggggagtaacagtaaagaaactgttttagaataaatctggtgacagcagaagagaatatgagacacattgtgctcacagagcctagaagagtgtgacagtagttgagggcaccgctgttgtcttagagtgaagtgaggagaacctacattggtgtggtagtcatgggagtggaaggaggaatgaaatgtgaaagcccattggaggcagaatcaaaatgccttggtcttaatagtcaactattaaggagaaattattggctgacttaggaagaagtgaaaaatgtgaaataccaataaaacaccaggcttgtgattttagtcagggtaaagcttaagcattgtgtgattctagatagattactgaggagttttgttccatttattttatgtccatatctttgagctatgattctatcctttatttcttgacatacccaaacattttttaaactattgtgatacagcttttatatgataagtctcactctttgaagtgtacagtttggtggtttttagtatattcagagttatgcagccattaccactacctaatttcagaaccttttcttctccccagaaagaaaccccatgcccattagcagtcactctgtatactcgtctcccccaccgttgatcctggcgacctctgatctaatttctgtctctgtagatttgcctatcctggacatttcatataaatagaatcatacaaaatgtggcattttgtaattgacttttctttgaagtgattataaagcaaatgcctgaagaggccaagcttaggatagtgtttgctgtacagctttgacaactgaattttttttaagttgaaaatattactgtgtctgtatatgtggcatattatccttagatgaccgttacttcaattattagaatttttttccctagtattcttgaactgtctcaatattcagtaggaaccctttggagacaaagagcagtaagaatttggaacacatattgacgaaatgaatgtcatttaatacagtagtagagtcgaccacttttaggtgtcagtgctgctggaagtgtatattaaggaaaagtttacttatcttacttatgtagtgaaggtactagaactacttctgtcttctgtttagatttcaacaaacatttgcataggtattatgcggttgtacaaatgtactgtcttttgacctgaaaatgcaaaaactttcttcctactttctgagactctgcaaccttaaaggaagagtggggtactttaaaggaaaggtggtgttggttggataatgggtgacaatgtctgccatatacttccttttcccaaaacaagttcctgtctaccatcagcatctccaaaatttgaagatcaagtgtggtgttaactcattaactaaatgactagactttgagcagttgtggaaccaaaatctgagtgagtgcctggatgttctaattctgttaaatcaatgagtgcacattatatacaatactctcttagcccagtggcagatttaaggagtgagagagagatttcaaatgtttcagaaatcaaatacacaaagaataaaaatttttaatcccatgattctttacctgagtttaatttttcggagagtttttcttttagattttcttttccttccattaaactttcactttgaaagctcccagggtttgggcaaagcaagtgggaaagacacttgcttggattctccagggcaagggagttaaagagggcttctttccctcattttattattgaataatgtcatgaaaacaattattaaggtgaatggtctacagtagaagtttttagatgccttctctgcaaaataatttggtttagtcaatgcaaggatgcctttggttagctggaatggaagatgcgcaggctagagtggtcttggcaagtcttctggggggaaatacagcatttggaagggtaggaagcagaaggaatctcaagcaagggaaaggtgtgggcagagccccggaggacagaaccgtttgtggtggacttggtgtccacatagatctaatcagtggtcttagcttttgtgctttcaaaattaccacagtttttgttctaaaactatcattcccttgattttactttaggcatgctatctgtgtattttgaaatttaaaataacattaaaggagaaatgaaattattttgtttgagaaagaattaaaaggttaaaacatcttgatctaaataattttctaatgggagatttggtacatccccagaagttgtctttggttcagagaacagtcttcagacctagaaaggacttgaggagtcccagagaggagccacatggtgtgaaccattcgattctcacaacagaatggataagaacaatttcaaccatgaaaccgtgcagatgttcatattttgaatagggtaagatcggtgccattgtcagaggaaaaactcctggccatcacaggttgggagagaaagtttccattgtaaagaacactcaaatgccatttaaggaaatgggttcttctgccctgattctttggaatatttagggccacgtttttagtttttgacatcataaaaatttcaaagtattctgttctgattgccatttcaaacaattgactggaatttcagagcaatttcataagagtaataccattagaatttttaaattacctataatcctatatgcctaacaagtatgttcatgcttacgtgttctcttcttgtctttactgtgtgcatactttcttaataatgccacatggaaattgtttaagcaggaatacttctcaagataattttgtatgtttccttttttctttttaaggtatgtattgggtggaggagcattatgtatggaacctctggtgattattttattattatactcaattttcaccctcaatagagtgttttgattatgtaagttagatcgtaagtagacggttctcttaaagacattttagtgttttttttttttttcgtagctcctactttcaagaatgaaaaaggtatcccagcagtttgggaggctgaggcaggcggatcacgaggtcaagagatcgagaccatcctggctaacacggtgaaaccccgtctctactaaaaaatacaaaaaaaatagccgggcgtgatggcgggtgactgtagtcccagctacccgggaggctgaggcaggagaattgtgtgaacccgggaggcagagcttgcagtgagctgagatggtgccaccgcactccagcctgggtgacagagcaagactccatctcaaaaaaacaaaacaaaacaaaacaaaaaaaacagaatgaaaaaggcaaaccagtaaaataacattgtgcttggtgctgaatttatgctaggataggcgttaacagtgacctttatttaaggttttaatttgttcatgttgggcacttagaacattggtttgttgtttttttgtgagattctggaaacgttccaattttaccttttccccttgactccagactttttaacactggtctgctactgttaagttatatgccatttggttaggccttctcaagtgggaaccaggaacgctgctgtgttctagagatgttttgttcttcctgtagggctgaagcagtgcctactcgatagaatcagtcatcatgcaaataaaagccacctgagtcaaaggcaaagccagagtgcagcttggagcaaagaaggtaattttattaagaattttacataaaccataagatatattttatgctactttgtgagccttcttcctatcttaattctttttgagagaattcatttcattttcatttggtttgttttctttttgttacaaagatgatctatagaacatatagaagtataagaaaattaaagttactaactgataatcacttaatgatttagtatctgattgtttagtctttgttatatttactgtagagaaacatgtctacagttgtaaatttattattgttatgtataccatagtaaaagttatatgtactttgaagttttgcaaaattgagttcatgttataaaattaattcctgatgaacttttatgtgctaggcactagtctttttatttacttatttttactttttttgtttccctctgtgcctatgcttaccaagtctttttattttttactttttattagctctttcagtcctcttaataactttaaaagagggtattattaatatctgcattttatggatgagacaactgaaggtaggtaacttgtccaaagtcacaggtggcagagcaaggattggaaccagacagtctgactgccctaggcccaaccaagaggagctgagagcaagccacggggcagaaggatgttggaggctggttttctgttcagttaacatgaaatgcaggctgtaaccgtaattccaggacattactgagaaagccttccaaagccagaggggttttttttgttttgttttgttttgttttccatgaccatgacttttgagcaaaaatttggttttgtttaaaggcaatatggtgctctaagaaacttccactcacacttatggagggaatggtagttgagctaaatagtgaaatgctgtagcacacagcctttagggcagcttctgacctatttctatggtcaggaaagacacctatctttgcctgctgcccacagcctctagttattcaccttcagaatttcctagtctgtgatcacattcagatgagagatccgttttgttttttccagggtagcaggaagtgagtcaccacctatactaagcagtctagtcttctgtgtataaatgagcaagggtggggagccagatctgagaaccttgtgtaatgctgagatgctccaagagaatccaagaggatgtcaggattatgcatggtggtaaagtggtctcatgttagttgtacccacagctctcatcagaagcagacacagatactttttgtaggaaaacatctctaacttaagcctgtaggattcccaaagattaaaagcaggcaaatatgaattcagtcaaatcatagcattcaagtagtctcaacccaacatatttgagaattgttagaaacaatgaatatgtttcccaaagactaggttttggaattatcagatacagaacacagacttcaaatattagaattgtgagaaaatagttacatgtcaaacctaatataaaagaaagatggactcattaaattgagcaacagaaaggccaccaggaatgaggaggaggacctgaaaagaaaatggatgaactagaacttacagaaataaaatatatagctgggtctggtggctcacacctgtaatcccagcactgtttgggaggccgaggtgggaggatggtatgagcccaggagttggggagacaagcctgggcaacatggtgagaactcgtttctgtaaaaaataccccaacaccaccaaaaaaaaaaaaaaaaaaaaaagtagctgggtatggggcacgtgtctgtagtcccagctagtcaggaggctgaggagggaggatcacttgagctcaggaggcaagggctgcatgtgcatgccactgcagtccagcctgggtgacagagtgagactccgtctcagaataaaatgaaataaagaaataaaaaatgtaattgttgaaataaaaaactcagtggatggattagacatcagaagaaagaattaattggttagacaattatctcccaaaagtgagtcagtatgttacacagagagacatgaggatagatgatagggcagaagttggtggggttgtagggggagggagatcagaatgaggtctaaaatatgtcttagtggaatcccaggaggagatattaaaattatattagaaagtgagagaaatagaagttctaaaggcaatagaaggaagtccacataaatcagtcacaacaaatgtaaatggactaaagttaccagttaggtggaactaataaaagaatatccagctgttttaatccatcatatttaaaatataaggatatgagaagattgaaagtttttataaaggagagagagtaatgaagatatggcagtatacattaaccaaaaacaagtgatggagcttcagtatcaaaaaaggattttggaacagaaagcattagtaagaaacttgatgctgactgttaattaggaggatgtagcaattttcatattttatgtacctgtcaaaatagcctcaaaatgcaggagaaaaactgataaaaccacagggagaaattgacaagtctgccagcatatttggagatttcaccataccctgcttaccataagtaagttacacagaatgcccatatgtagatttgaataaccagtgaatggacatggtgtaatggacaaatataggcctttgtacccaataattagatattctatattcttctcaagcatatgtggactgtgggagaaacattaattatatattaattcgtaaagcaagtcagaagatttaaaaacaattggtaccatccacaccatataatttataatttaaatatgaagcaattaaggttagaaggcaataatgaagagattaacaaaaagctacatgaatttggaaattaaacacccttgtaattcatggtataaaaaactcaatacaattttagaatgcttagaattgaaccatagttaaaatatgaaacttctctctgttcctgtctctctccctctccctctctcttcctatctggaacattcaagaagctaatctttttcaatgaagaacaccccaaatactgaaaagtaggaaaaagacagatggcatttcatggtaatcccttcccccaagagtgtagaatgtttctttagcttctttgatagtttgtttacttatttattaagtacttactataaaccagactctgctttaatttgtgatgaacaacctagagattaagtcctgccctatggattttatattagagtgagaaaaacagatagctaagtctggagctcaggggtgaggcccaggttggaattatagattcacttgaccaaggtgaaacctggtgtgccccctcctacttcacatccccagacatacttctggaacatttctgttctattcttgtgtataaactcttccttttgagcctctctccattaatgcatgtcaacctctacttgtcttttgttgattttgaggccacttgcccatataacttggaggatattgaagaagaatcataccgacctggttctgctacctaccagctgagttactttggtcaagctcttggacttctgaggctgtttcctaatttcaaaagtgggtatatgatgtgttaggccctggtgggttgcaaggaagaggtacacacataccacctttgatgatgagggccgaatgttaacttggatggaaagtcatccaaacagcgatattgtctctggccctagtaatttcaaaacctcacagaatattaatttagcagtatttaggatagggtttgagctctgaagacctacagtatggttatttgttcatatggctgttttccatactagaccatgaactccatgagggcagggtctacagtttcatctttgtctcctaggcactcagttcagtgcctgatacataataatagaggcacaaatgttttaagagttgaggaattttcaactctttctgaaagaataggaagatataaaggcttctcagagacggtattatttaagctgattttgtttttgtttttgagatgaagtcttgctctctcgcccaagatggagtgcaatggcgtgatctcagctcactgcaacctctgcttaccaggttcaagtgattcttctgcctcagtctcctgagtagctgggattacaggcatccaccaccacacccagctattttttgtatttttagtaaagacgaggtttcaccatgttggccaggctagtctcaaactactgatctgaggtgatccgcccaccttggcctcccagagtgctgggattataggcatgagccaccatgcccggcttatttaagctgattctttaagggtaagtagaaattttttccaggtgaataaaaccttgagctattattccaagcagagaccagtaggtgcaaagacacagggatatagagatgttgaagtttaccaaacactgctagattaaaaaaacaaaaaggaaactatcaaaatcaaaaattaaaattaaaaatcacctataatacaagctatgaatgggcttggccagaggtcagatcgcaactgagttaactatgaccgtagacactcagtaatcgatggaagttttagggaaaacacataacattctcaggttgttggcagagtatctggaacaatttacaaatacgggcattgaattctgggaataattacactgtagtgatatcatttccttctctgcgtatgaagcatgtatgtattgcacactgttcaaggtgctgaaaatcagactcttctcgagcaatcaagggagatggatgggtgagcaactgattatcatgtgacaagtgaggtaacagagatatgactaagatggtatctaaacaagaagaaaggaattattcataatatatggagttctggggaaatatttctcaaatgaagccggccgggccggatggctcccacttgtaataccggcactttgggaggtggaagtgggaggatccaggaggatctaggagttcaagaccagcctggtcaacagagcaaagccctgcctgtttctatatttgaaaaaaaataagtaaatttttttaatgaaatgatatttgagcactctggagcaccatacaaatataggacagactgaaggaatgtacctggcttgagttaacatttattgaaattttatattgcaaaaatagtacatattcactgttttgaaactagaaagaattgataggcaaggagggctgtctacaaagcactccatagatccaccatactgagacaatgcttaatgctttgatggatttattgtatactatctatgcatatgcatgtattatatacatacatgtgcatggttaaatagaaatatttctccttggtgttaatccatttattgttatgcagtaaatccccaaagagcacatttgctttgcccaagggagtcttttgctacatactgctgtacataatgaaaactaaaaaattggctaacttttcagccttgtgaccttgtggtgattcaaatagaggcttcatcaaaggcagattcagaaatgaacttggtatgtgggtggttatgcttggcattattgtttgtaatagtatgatagggatgacttcagtgtccaccaacagggaactggttaagtaaactgtggtacatccaaacgatgaatactgtgcggttgtaaagaagaatgacaaagacctctgtactcatgtagaagaactcacatatattgtgtgtgttttaagaggaacaaggaatggtatagtatgtatggtatgctactttttgtgttgagagagaagagtagaataagaatatacgtgtgtatttgcaaacataaattctgaaatgatatataagaaaccaattaaaagtgtttggctgtagaaggagaataagactgtgaatgggatttggccacatacttttataggtagttatatttaaaaattttctgaaccatgtgtttgtacacatgacctttttaaaaataagtgaatgaaggaatgaagtaggattatgagaaagagataagaacaaatgatctaaggggctgcccatctttttagtacccagtgaatattaatatataacaatagcagcaaaaattggaagagtagccccaggagggtagggagtcagcctttcctttgtcttttcctcaatttcatatattaaacaaaataatctgagaacgataaaacaatttgaaataaaaaatgtctccagatctcttaaaaggaagctggggcagctttctgtagcgcacttcccaaaaatgggctgatttacctcaagaggcagggattctagcctacatgggatacatacaggagaaaacaaaatcagaaaaagaaaagagatttaaatataaataaatgaaaataacaattctccctcattataaaggaaatcattctttttgtaataatttggatgacaaatattaagaaaaatctttaatttgccactcaaaacattgtggtttgttgctttttatacgtttttatgcacataaaccttttaaaaagtagaatcgtagtatgtagtcttttgtcacttactatattttgggcatatttctgtggcagtaaatatatcctggcatcatcatttttaatagctggatgtatattaagttaatcactgccaccccagaggtgaattttcttatacacacattttaatgggctcgagcaaacatttttggactgaattcatagaagtagaatttctggaggaaaataatttttagggtttttaatagaaattttcaaatcattctccaggaaaagtgactcaggttatactcccaccaacaaggacagagctccaggttcccctttccatttgtcatctttcctgcctttatacagaaaatctcattgttttcatgacatttctttgatttcttgtgcttttgaatctttgtatatgccattggccatttttattcttgtgagaagtgccagtttctccattgcccattttcggttgaaaatcatttgtttttttttctcagtaattttaaagatttctttatagtctaaggatacaagccttttatctgtcattgaggtgacaaaactttctcccagtaagtaatttgtcatttcattttttcttcttttctttttcctttcctttccctttctttcttttccttgtttctttctttcttcttcttccttccttgctttccttttctttcttgctttccattcttactttcttttcttttccctccctccctccctctctttctttcctctttctttttctttctctctttttctttcttctttccctctctctctttcttcctttcctttctttctctttattccctccctccctccttcttcccttttttttctttctttctttcactagccaagctccaaagtcacatttcacttaatttttatcctgccaaatttgaaagccttttaacttcgtgattttagtgtaaacaggagcaggagaaaatgtaattatctaagtctcgctgtgtcacccagactggagtgcagtgccataatcatagctactgcagccttgaactcctcgcctcaagcaattttcccacctcagcctgccaagtagctaggactacagctgtgtgccaccacacccagctaatgttcaaaaatttttgtggagatgtgaattctttatgctgcccaggctagtcttgaactcctgacttcaagtaatcctcccacctcggcttgccaaagtgctgggattacaggtgtcagctactgctcctgactgagagtttagttttgtttgctagtggtgttcttggtatcttttcatatttgaggttttgggctagtgctgaagtattacactcaccattcgaggtctacaggacttttggtttaatattgaacagatggaactgtttagttctgcatctttgcaggtatacagaatgtgcctaccaggaatctgctttatatccattgaaagcaagaaataatacagtaaaactttgcctggcgagaggctttgaaagaatggcgtattctggtttaattctattactttggaagtataaaggtgaaaaaaattcaaaacttaaatttcctgttgaatgcaatttgaaaatatagccaatgattccacttttcttctctagtaaggttggacattctgatctacttggtgttttattatagaactgctagtgtgcgtgagtcttacattgtgaagatacttttttaaaacttgagatgtaagaggatgtaaacggttttgtaggagatcaggctggatgagaatggacacttgtaaacatactttttagactaaatctctgattgccgcttgtttttcttatggaactcatacaaataaaacacattggatggagggtgcgagtaggaaggagattctggtcttttaattgcatgtcattgtttcataacaaggcagaacatatggtaaccctggctttggacctacagaaggaaacacatttttctacctgctgtatgccagaggttcttgaacacttggagggattactgcagcacagattgctgaaccctactccagagtttctgattcaccaggtccagggtggggcctgagaatttgcacttataaaaaggtctcaggtgctgctggtgctgctagtccatagactacattttgagaaccactcttgtctattaagtgtaaattgtagaactctagaaaaaagcttagttcagtctgggataagaagcacacaggttatggagaaaatcatgaaagattcaacccttgatcccagcctagtgtggatttcaggtaacaagcagtacacagtgacataacacaattcttggttttcatgattgcaagtcatagccaggtatcaagtgagaaattcagtttcatttgcaaggcctagagaggcctggtgattctagaaaaatgggccttgtatttgttttaaaccagtaaagagctttaagtgcttattaaattgtaagttttgtgttcctacttattttgtatcttattttgttttattttatttcttttgagatggagtcttgctctgtcacccaggctggagtgcagtggcatgagcttggctcactgcaacctccatctcctgggttcaagtgattctcctgcctcagcctcccaaatagctgggattacaagcacccaccaccacacctggttggtttttgtatttttagtagagacagggtttcttcatgttggccaggctggtctcgaactcctgacctcaggtcatccacccacctcggcctcccaaagtgatggcattacaggggtgagccaccgcacctggcccaaaagctttgtgtttttaaagatattagacatgtttcttgtttttaaaagaaatcttaacaataatgtaggagaataagacaaacatttttccaaaaaagagaaattgttgtgattattctctgttattggaatgtcggatactatagtcagcttcattaatcatcaagaatgctatggattttccatttttatagggtctatatctcagttaaggtaatacttgtaattcttgtgctccatttgaagatgaaaaatataggccaaaatcatagactttgcatagaagctgcataatgaagacagctctggaggaacacatagatacacacagacacacatatataaagtatatacacatatattttttaaagtttatttttaacagttttaaagcttttaaagcaaaagccagcccctcccctctcccagagtgggcggcctctcccctctctctgagtgggcggggacagcggttgcatgggcagctttccttatgatgctacaggtccctctggacatgctgcgcctggccacgcctcctttccctttcatctttctcactgaccaatgggcttggaacattaaggccacgcccctattctgcgttccattggtgccctggttacgccacctgtggctcagttgcacagctgcctggtaggtgactggaggcattgagcagtgctcactggtatttcgctgatgtggccccaaccccgcctccctccccaccccgcgatgtcagaaaaaacacaacaggggaaattggccgcagccaagaaaaaggtaaaacacaccaggtcatggcccccaacccagccacagatcccctccgatgacaagaccggtgccagagtccataccactcctgaggcataccagatggggccccccaaccccagcccctctgggctcccccaaccaaagcctagtcagtcagccccaccccttcagcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagcgcccctaggaactgtcattactgctgcaagaccagcctttgatcttacaacccagtcccctaagttttctcaccccatttctggttcctctggttgcagcacaaatttccagctggaaggggagtggagactatgggacctaggagcaacaggtttcaggctgccttactcccttaacatagacattgacagtgggaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgcgggacatctttctgaagcatcattttcccttgattctcttgagaaaatgcattaatgtacttggggatgacagacacataggtttccaagcgtataccagactttgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcgtggagtcagaggactgagtttaagttccagtattgccttttttgatctttctttttttttttttctatccatgatatgaatccctctcagtcactgattgtgacaacaccttgtacagttgttggtggcattacatcagatggtatataagggtattttgtcaaaactgtaaaggaggatgtggctgtaggggctgatcattctcatgagtgttactgctcttctttcccacagttaaaagcatattggcagaggaagagccctggcattccagcaggagctaacaggaaaaagaaagtcaatggcagtagccctgacacagccacttctggtggttaccactcacctggggatgtgagtctcggcgggccaggctcctggggacagggggcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaagggtccaagataggcagaaaagaagcttttgccagttgatgggggaagaaaggaagtcagagggcttagacagtgaggggggacagaacatctccatgtgcactctcatctcttggagtcagcaacaggtatctacggggagggccgtgcatcctctactaccctgcaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatctttctccaactccttctctctgcatgcacctcagagccagtaccaagaactagcagtagccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgttaggggtccatattcctgccctgcctcagtccctaatttgctttttgagtctggacaagccatctctcctctttatgctcgtgtttctggaggaggtagagagtatcaaaggtctcggttagctctgaaagtcagagatttaaaggcccctagaatggaaagctcagggcgaagggctcctgtctgtcctttgctgttttatatctctgctatgaagaactgtacctggcctgtacatgctcagtaaatgtttgttgaatgaatgcacgtttctaaatcacaaactggcagaaggggggtgggcctttctcaaactctgtctctggaggttcaccagcccctccctccaggacccttttccccctttgctttgggcaggttcgcacatctaaggaggagaagaagcatgagatacatctggtacagaagcttgggaggagcttgttcaaactcaaaaaccagacgggtaagatggggctggcatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcacccacccacagtgctctctatctgaaagtgacttggaagattgtctaccatccgggtgtgaggagtcattagcagtgaggccaagtttgggaagcctgagaggaggagctgtgcaccaaagggaggatttttttttttttttttgagaatccagaggcccttattctctgcttgctttctcagctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttaaaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggttgcgggagctggagaggatgctggagctggggtgggaagccctgtacgagcagcgggccgagccacgcagcggcttcgaggagctggtacgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcagacactaagttctggggtctccagttttagtgggtggccactgattgcttctctctgtccagaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcgggtgtggtggctcacgcctgcaatcccagcactttgggaggctgaggcaggacaatcacttgaggtcaggagtttgagaccaacatggccaacatggtgaaagctcatctctactaaaattaaaaataataataataattagccaggcctggtggtgcatgcctgtaatcccagctactcaggaggctgagacacgagaatcacttgagcccgggagatgaaggttgcagtgagctgagattgcaccactgcactgcagcctgggacacagagtgacactctctcaaaacaaaacaaaacagaaaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttacatgctgggaaaaaggacgtgagatttgatgctagggaaggaggcatggggttctaagcaagggagacagtctcttaggcctggagcaaggggccaggggcctgggcaggccacagagccccacagtgccctcgctaccctattaatgggccaggaatctggaagccagccaccacatgtcctcatgcccagggtcttccggcaggtggagctgaagagccaagaggctccgagtctgcagcagcagccagaccagtacctggagccccagtcccacaaggagcttggatgtgcggacaagcagggtggtgagtagagccctcaggcggggtgggcaggcaggagcaggggaggctcgcactgtgcccagattcccaccccctccctctctctgaagatcttagtgagctgagcctcactgatagcttggaggctgcaccgggagaggacagggagggttctcccccatgacaaccccactgcacagcagatccagcagctgcttcctctaatgcaggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtactgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaacttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcacccctttaccattagggtagcaagacaagacccttgtctaatggagggagacaaacagaccctttaccaccttgaccaaggctgagtccttacatttctggatgatgatgtttgttatttaagagccagaggttggtggagttggtttgtttggaggaggtctgatggccttcttactctcaccaaagcaacttttccctcaggggggctcccatcttcttactcagagaggcagctgaggcgggacagtggagttaactgtagaccaggccagggcacaggctgctgggggtggccccccttcccccgtgtacatactgtagctgtgtaacattctgtatcgtacctagcggaggttgcagctggcatatgaggaagaggttcttataattattcgcggctgggaaacttatttattgctagcataggagcgaggaaggaggcggggatggggtcatggctgcctggtgatgggactcctgttttttgttttttgttttttgcttttgattttggaataaatggatttagccatactgctcggcctgttatgttcccatttccctcactgggtcctgcagtttgtcccactgaatgaggagccccagagtgtctcagcatgtccagctgggctgttggggaccttccaggcctgttacctgtatgctgcctggtgacacctggtggattttatggggactgccatggcgcctacagagtacactctggccctgacagccaactggttgagaagcctgatctagctgtggcagggaagacagataccagtgcccaagggcactgacttccatccaccccacgtgtcttccattccgtccccctgcctccctctcctgtctgcaccgggtggcctgtctgtccctccagagtgccggctgccccgcaggttccctccaggctgagttcagggccctgcccctagtggccagagctggcttcacagggtaagagccagctaagctccagggactttccaggaaaagtgtcccttgaaaagggtgtgaccttttcactgctcccaacaacaccctaaaaatggcttggccttttccatcccctgagctccatagagaacacagccagcagaggacacattctctgtcatccagaaatgggtttctcagtcaagggacagcaggactggtagagactgtcaggccacacagctgcctgcacagcaccgccatgcttggccagaagggcgggagggatggcgggggctggctgtccacaggccgcgcatgtcccggaagctcactggaggtggtgcactttggaggggcgatgtcaggagacagcttcctcttgctggtctacaagactccacaagcacagcacggggactgattcccagtgctagaggtgaggcagttggccacgtgtatatatgtatatgtgtgtgtgtgtgtgtgtgtgtgagagagagaatttatagctatttatagaacagggcaggggcataccacagagggggcacaagtttcagcaatggtcacacctggacgtgtcagctcaccgctacaacagactaagtcacagaagaagggggctggctttggagctgggggagccactgtcaagtcacaggacacccgcccaggcaggcttggaaagggaggtctctgagaagagggatctgtttagaggtcgaagtggggcctggggctctcaggatgggatggacttgcctgacccgatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggagggagatggagggagaagccagagcttcataggtagtgcctggggactgcggcggccctccctaccccacacacgctggcctgtctcatggaacccaggcaatccacccatccacccacagttcagaccaatgccagctccctcgggcttccctcttctgtggtccccatgtcttccaacccactggcccagggccacctcttgcttggagagccccatccaacagccaccagacctgatagagaaggaacactgattgaaccaaaatggtggagctataagggatggctggctggagtgaatgccagaggcccctctgggccatcagaaagcccagggtcctctgagggaccctggggaaggcagggagggcaggtagccggatgccattggccatagacttctaattctaacaggggagcctcaactggttggcggggggctgcaggttacataggtgaggctgggcccttcctgctgggaaaagcagaagagggagactccgcggcaggaaagggaagtgagctctctaggtggagctcagctgggccagcagcactattggctgaatagcacaggcgacccctagaagcaacaggccaaggtgcgtgagcctgctggccagcagtagtgcttcagcaggggccagggaccctgccttcagtcgcacgctagcagctatcatggtacctgggagggagggaagggggctgtgtgtccttccatggcctatgaagtgtgttgtgggatgaccacgtgtataggactctcaggcttttatcctagatcaccactggattgctgacagatagaggacgtgggaccgtgactatcacccctaatctgcagtggatttggctcttggcactcccaggctgggagctggatacctgccctggcagcatgactcagactgcatgacaggtacggcgtgtccaggatgatgtgcccaggcctctggccgcctgagtccagccccccacacaaccccctccaagctcccagcccctacaccataaaccatgagctctgtgccctctctgatggttccacatctgccaccttgggcatggagcctgttgtaagagcccccaggctcagccatggagaccttgagcagtggcactgagtcccgtggctcacagggagcaaagtgagacaaccagcagcacaaggacagaaagaggaaagagcaagtctgcagctccagaagggaggggcagggagcctggctctgagactccaggcatgccccctgtgtggagctggggcagcggggcgggcagaccattcatgcagcaggcagtgagacttgtacctaccatggctgacgctcctcaggggccactgatagtgattctgaaagacagcatcaaatcacatggcaggtcccatgcatgggtggggcaggcctgggggtggcagacacacgcacatgccagattgtgcacacacatgctgtgaggccccacggcccgcatgcacactctaacagatgcccacaaacaacacgcatacgtcgccctctccgccacctcccggtgcccagcaccctcaccggccggcacgtgccgcatggatctggggcgtgcagccacacggcacactgaagcacatgcgtgggcagagtcacaacacagatgctcacccgcacacagaggcatttgcaccagctccctgcacactcgtgcctggcgtgctcagaggaccacccatgctgctcagggagacagggcttgctcactaatgtccggctgtcatttctccacctaagagccttccatggctccctactgcctacagcgttgaatcccaacaagtcatactttttggactttgaaggttctccaccctgtgccccaccctccccacagagctcttcctcattctgtctctgttccctgctttggccagtggctatccgcgatgtgacccacactacacctctgcccacactgcagctctttacccagttaccctccagttcctcaccacgtatgcctacctcagtcatgccccggactgcattgaagccaggctgccttgaagaagctctcccagactgcccttttccccaaggcagggtcatgatttgccaaaggtttcgtgtgtgttagcaagactggagtcggagcaggcgtcaaactttacatcccatatgtcacacctcaccatagatctgggtgccaaatagcctgaagagtctgaactcacgttggaagttagcaaagtgctcctacagccgcatctgcagttaacatagtatccctatggccactgtctcccttgatccccacagccatcctaggagaaaggcagaacgtcatttgctagaagggatgctgaggctctgggagggaaagggacttgcctaaagccccagggtgaagcagcatctctggactctcatagacagcctagagctgccagcactcccttaggatctgtgccctcaggcctggcttaattttttcctctgcaaagagccatctgtagggccagaggctggcaaagcctgactcattactggacgccagttcctttgcctgacattcagtgatttctgccttaccctggggttttatgttgcttgtctcaacactgtcacttctcattcctccacaagttgaattgctcactccagccacttgaagcatgctcttcttaacacagttagctctaggcacatggttggtgctaaaaaggaaaaaaaaagaagaacgttatgtcaatttcattgattaacaaaagcgatggctccactgcaaagcaaagttgacactcctgggtctctgagttcaagagcctttagaaaaatggctctgagctaaaacatgatcatgcacgcatatgcatctgtctcggtctgatgagataatctggatacttgcttgttatccttgagcattttcctgcctcattaatgtatgtgtagccaccacaataataatcatagctaataatggctacagctgagggctttcctgaaccaggcagtggttttaaaaactttaacccctaaagctgaggactttcctaagctagatagtggctttgaaaactttaaagttttcacatagactgtcactgaataatttctgtttttcagatcaagaaactgagacttactatcatatttgggattaagctaaaaaaaaaaaaaaagaaacagaggctgaacgcgtcaagtatttcacagccagcaggaaatcagaacttgaacccaggcagtctagccctgggatcctttccccttacccattatccagtgttggctacacaaaactaatgagtacatattttcaactatagtttaagtgggtgacatatttttcactatattttatgtaggtgactttcagtttgggggtattctacttacacaatctattgagctggatattaactgagagcaaacagaaactaatgaactctgaaaaacataaaacatgagcaacatgacatcactgcaagagacaaaacagcacatagccttcttgtgactgtattttgctgacagtccatgagatgatagcctgaactcagcagtgctgttcccttgggagacacacacacacacacacacacacacacacacacacacacacacacacacgagttggtggttgtgctgcccggagcctccagtccgcgagtgtgaagaacggaccagatgggtccagcagtgctgggtcaaggcgaggagggggcagccggaagcgcgcgcatgctctggactcctgcagccgccaaaacgggtgcgcagggtgcacgcgggttgaggggtgaggggcgacgggtgtgaggggcgagagggacgggagcggggtaggggcagccctttcccaggcggtagcgggggctgtggtgctgttgcccttttaagctgcggcttgacaggagcagcgtctcctgtcggtggagtctgttacaaggggagcagccgcccaggccgccacacagctccccgcagaggcctcggtgccccttgccattttccagccctactccgactagagttgaggcagcagggagaggcggagctgggagagcgccgccgagaggtcccgcgggtggttgcggccgtgacagcggctcccgacgggctcaccttccgcgcccctcccgccagaggtgagagtaaaatgtccgtgtgagggttcaaggccaagctgaggttgttggcctctatcttccacaagaaccaggagcccccgccacagctcacgctccactgcaacatcacggtgaggcgcccagtggcggcctcacgggccagggcgagggcggagaggaggcgcccagagtcccgggacaaaggggagcctgcccgggagaggccccggttccccaggcggggcgagcgcgcccctttctcccgcgtctggcccgccccgctgtgtgaggcttgcgtgggaggagggggagggcgcgtctctctggctccttgccgcggggctggcttgggggctgccggcacctctcgccccagtcgctgcgccctgaggtgggagcccgcgtcgcccgcagacctgttggggcccatgatcgccctcagtcagctagcctgctcccctggaccgcgacggggcgtggcagggcggctcccgctgttgtttgagcccagtgagggaaggggaaaggcctttaagattttcggttttttggccgggcgcagtgctcattcctgtaatcccagcactatgggagactgaggcagctggatctcctgaggtcaggagttctagaccagcctggccaacatggtaaaaccctgtctctactaaaaatacaaaaattagccgggcatggtggcaggcgcttcttgagatggagtctcactctgtcgcccaggctggagtgcagtggagcgatctcggcatactgcagcctccatctcttgacagtctgtgggttcaagcgattctcctgcctcagcctcccgagtagctgggattacgggcgcccgccaccacgcctggctaagttttgtgttgtttagtagagatggggtttcatcatgttggccaggctggtctcgaactcctgacctcaaatgacccatctctgcctcccagagttctgggattacaggcctgagccaccgcgcccagatccaaggcccttaagcttaaatgcctcgttcttcagtcaggttttccttgttcccgcatgttcagccaatcgtgtttaaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggtaagagtcctgtccaggtgctctgcccgcttttcctttcaggcttctgtatcagctgtttttcccctgtagaatgtgcccctgacagccaccccctaaccctacccaatttgtctttacgtgtctgaccatcaaggctcttctgggtcatatttaattcatgctgatatttccccttcctcccctctttagtcctatttttgctttggttatgttatgctatattctgtaaggctttaaaaaaatttttatggtggcaggggagaatgttttataattatgctttgtgctttttatcttccactcaataaatgcttggtaaatatttgttttattgaatgtatgaccctattctagctatattgtgcttgaacaaaaaccttaactgcctagtaagttaactgctaagaatttgtcagaagtgcagacataacatcaagaacttgtcatggatagtacaaaaacgtcacttaagggcttggtggaagcctgtaaattgacttcctatgaaagagagtgtaagaagtgaaaatgtaaagcatgactggagagccagagtgatgaagccagggtccctttctccagatcctttgtaacagtgttatgtgatctcttctagaagatcgttctgaaagataatgccaactcggaacctaggaaaccatccagtgggtttctgcagcttaggtgtttcaaatcctcatcagcacgtttgttttctctgcctcagtttgcttacaatgatgttctcagtagctacaattgctgtctttgaatacgtaagcatttttttttaggtgacagggatatatgtgcatttttattttaccaagtgttagaattttgactctgcttttgtgggctctgggttagctacttggttgttgtaaaatgattagcagggaaagctgtgtgtgtgtgtgtgtatgtgtgtgtgttataagtttcttttgttgtcagaggacttagaattttattttatatggtaattctgtcaatttactttattctccaccccacatttattgaacagcaaattatgaaagtaatgtgtcccataagcagccttcagaagaattacaactgctgtatatctgaaattcttttttttattttttattttgagatggagtctcactctatcacccaagctggagtacagtggtgcaatcttggctcactggaacctctgctgcccaggttcaagcaattctcctgcctcagcctcctgagtggctgggattacaggcacctgccaccacacctggctaatttttgtagctttagtagagacaggtttcaccatgttggccaggctggtcttgaattcctgacctcgtgatctgcctgcctcagcctcccaaagtgctgggattacaggtgtgagctaccgcacctggctgaactttcaaggagaagtttgtgcatcagttttcaaaaaattatgatatcaaaagatagctgtgccctacatttggaaagatacaaaaactgaacatactggcaggcagttttgcttgctggtgcttgagatagaggcacacattggtctcagtggaattatggagaaaaatagataaagttatttctaaataagaccaaaaaatccttttcttaagcagtgacaggtaaagaggttgtcttggctaaccttgaattgtgttgcccttgattgagacagttttatggtgggatggtagtggtgataaacttgctggaaatttgtctgcttatagtaacctttgtggtagctgtcacagacaacttcatcctcacaggccttgaaattagtataaaactaacagaatggaggagaaacaaaggacctgaataattagatgcttagataattgttctgtgttttcattactggtgaaaaagagcagtattagaagcacttacacattctatagaaggaacactgcctgaatttatattgcgatttttgagcaccattaactgtataaaaacaggcatattgtaggtaatattttaaagacaaacagaaaatttatcttttcaagatggatctaaaacttatcaaaattacaaaatttaaaacgtgattgaaaaatattaatgtataggtttaaatattggtcattttaaatgtctttcaaaatagattgtctcttaaatattcaactgaacaaactttgaacatgttgtagagtttgtgccgaaggttaaatttcctggggtgatggatattttgtaatatggaaaacaaaaccttcttattttaagaaatttagaaaacttttaggcaaaactagaaaatattacctatgtaattctaccactcagaaggtgccactgtcagaaatttgtatctttccagtcatctgctcacctcttttctcctgtgcttgtgtatgtttcctctcccttaaaaatcagatatttgtttgtaatctgctttttcactcaacagtattgtagatccatgttataacttactcctctacattgccttcagttattgtgtgctttctgttggatgactttaccatgtagtcagtcatgttttctggtactgaatacatacgggtatgtgtgtgtgtgcgtgcgcgtgtgtgtgcgtatttttttgtaacttaactaatgctttagacatcagtaggtagacgtaaatccttgaaaccttccacgtggtgactttcagttctcattgctgaatttgtttccagagatggaagaaattatattgtatgggaactttttttttcttttttttttctttttttttttgagatgaagtcttgttcttgtcacccaggctggagtgcaatggcgtgatctcactgcaacctccacctcctgggttcaagcaattctcctgcctcagcctcccgagtagctgagattacaggcgcatgccaccatgcctggctaatttttgtatttttagtagaaacggagtttcaccatgttggccaggctggtcttgaactcctgacctcaggtgatttgcccacttcagcctcccaaagtgttgggaatacaggtgtgagccgctgtgcccagcctttttttcatctcagtaccagcttttatttatcagattggtaaaaatgttagaaagtgtgcaatgaaatgggcattcttacagtcatggcaaaaaatataattatctttgactttctagaaagtagtttggctttctagaaacttgtttgaattctccctgtttaggcaggatgaattctcactaccccaaggtggccaaccttgtccctgtgattccatctctcccagaaagagaggtctagtctcagggaaaacccagatttgtttggcttagcccatctgacagctaatcactggaaatggggtaggctggtagaatgctttggtcaggttttgtgttgagagagaggtggaaagatgggagggaggtagcaaaacttgcctcagtggaactatgtaagttaatatagaatggcaaagggatgtttcttccaaggaagaaattctagagaaggaagaaagtggaggggaaggcagcagttctccaagttttggggtcaggattcctttacactcttaaaaatacattgaggtcccaaggagctttggtttatgtagggtatatctattggtatttatcactagaaattaaatcagaaatatttaaaatattgtttaaaagctcaccacatattgttataaatgcttttatgaaaagaaaatttctaaacccaaagtagtacagtcttacatcttttgcaaattattttgatgtttgatatgtcatttgcatgatgtttgatatgtcattagcaaattgatatgtcagtttgcttctgcattcaatttattgtgtgatattttcttgaaaaaatgtgaacaaaggccagtctcatacagataaccattttagatcattgtggatatatatatatttttttgagatgaggtcttgccctgttgcccaggctggaaggtagtggtatgatcatagctcactgcagcctcagtctccagggactcaggtgatcctcccacctcagcctccagagtagctgggactacaggtgtgtaccaccatacttggctaactttttgtattttttgtagagacagggttttgccatgttgcctaggcttcttttttgatactccatcaaatcttggtttttcttgaactttggatcttccacccttgcatgatattacaacatcgtgcattggtcacttataaaacagtggttcactaagatcttctacatgttgatacatttgtacagtatcaaaatacattcatcagtaccaccatcaatctcatcagaatacttttggaaagcgatggtgggcataagttttctaaaattctaattttttgttcaaaagcttgaattttattagtaattttgttattgaattttattatagcctgtctgttgttttccttgaaatgacagaatctcatgttttgagaaaatatctgccagaaatgcgagttaaaataacattttttgtcagtcagcctttcaagtaaaaatggtattccattaaagtggttaattcacttcatgacttagccactcaagggtttttcctcaggcagcctgtaggaatgctcatgtatacttcccatttcatcacttgaaatattaaaaagatatattcaatgatttagatatagtaaaatattcactgcttcatcatagacattcttttttttttttttaattttcgagacagggccttgttctgtcacccaggctggagtgcagtagcgtgatcacagctcactgcagcctcaactttctgggttcagtcaatcctcctgcctcagccttccaagacgctgggactacaggcatgcagccactgtgttcagctaatttttgtattttttgtaaagatgaggtttcaccaggttgcccaggcaggtcttgaactcccgggctcaagggatccccctgcctgggccttccaaagtgctggaattacagacatgagccaaaattcccaaacttatcatagacattcttaaatgaaactgaccttttgttgcccttcctttttatttttatttttggagacggagttttgctctgttgcccagtctggagttacataggtgcaatttcagctcaaggcaacctctgcctcccaggttcaagtgattctcctgcctcagcctcctaagtatttggtaatacaggcatgcaccaccacaccgagctaatttttgtatttttagtagagatggggtttcaccatgttggccaagctcgtctcaaactcctgaccttaagtgatccgtctacctcagcctcccaaagcactgggattactggtgtaggccaccatgtcccacccacccttcctttttaaacctttcctgtgcctaatgaagaataccatgactactagtagtttggtgttactgcttttgtttgtgctaaagtaccagcatttttacccaccattgtatttgcacacttacagcaaatgtcaccatgttagtattcctgtcaaaatagtttggacttgggggtctgagggccgcactttgggaaccattgaaataggtacttagacgtactagatatcatatcttttcatctacaaggtttttaaaaacttgatttcagttaattttttttttgtaacttttaaaatatggttttgaggggtttcagtccagagcaacaacacgtattttattttgcttatgctgaagtttactagaaaatactaacctaacagaatgaagtcctaaatctaattgcaatttccttagccaaaagaaaaaaaaacgaaaattaaaagtgtaaaaatagtccatatggtgtattctcagtgtatgctgaagaatttatagaagaaaatgcaatactcagtaactggtgttctttaagaatagggttggctgggcgcggtggctcatgcctgtaatcccaacactttgggaggccgaggtgggtggatcatctgagattaggggttcgagaccagcctgaccaacatagagaaaccccgtctctactaaaaatacaaaattagtggggcatgatggcacatgcctgtaatcccagctactcaggaaggctgaggcaggagaattgcttgaacctgggaggtggaggttgtgatgagctgagatcgtgccactgcgctccagcctgggcaacaagagcgaaactcggtctcaaaaaaaaaacaaaaaagaaaaaaaagaataggagtaattctgaagagtttcttttagcctgtaaagagatttggaacacagtaagagaggaatgagaagaatgagaatagtaaaataaaccattattgaagagatatgctgttaatgatgtcctccatcaatacaacttgtttctctttttgtttgtttgttttttgagatggagtcttgctctatcgccagcctggagtgcagtggacatctcagcccactgaaacctctgcctcccgggttcaagtgattcccctgcctcagcctcctgagtagctgggactacaggcacccgccagcgcgcccagctaatttttttgtatttttttagtagagatggggtttctccgtgttagccaggacggtctcgatctcctgacctcgtgatccgcccacctcggcctcccaaagtgctgagattagaggcgcgagccaccgtgcccggcccatcttgcttttcttaaaaaggaaccttcagtaaatatttggtttctgtggcttcagctttaactcagattacagttttcaaagcactgttgcctaaagttgtttgtgcaaaattgttttctgtgacttgaacctagttattctgaaactaatatataataataatggtttttccccaatttataatagagaacagtacaaagtaacagcgggaacgtctgttagtgggtgaaagcacataatgcatagttcattagcttttttaaaaaatcacatgtaattgtgttacaaaaatatatgtatagtaatggcatttacttggtattacctggtttgtgtgatagaataaaatattagaattttatggtgtttgagttagttatctattgctctgtaacaaactgagcagcttaaaataacaaacattatctcagtttctgtgggtcaggattctgtccagtttaccttgggttcactggcttggcctctcaccaggcagtgaaggtgttggtggtggctgtgatcatcccaaggcaggatagggagagaatctgtctccaagctcaggttggcaggattcatctcagaggctgctggactgggcctccgtttctagatggctattggtcagaggctttttacaataccttgtcacgtgggcctctccatagggcacctcatcacatggcaactggcttccatcagagggagcaatggaaagagcaggagaagggtgaccaaggcaggcatcgtagtctccttgtagcctcacctcagaagcgatgttacttttgctgtattctctttgttagaagtgagtcactaggtccaggggtggaattttacaagggtgtgaatggcaggaggtgagggtgatcagggccatttagaggctgcctaccagtgttgaagaaaattgttgacttctatgagctgtagcagcagacagtgctatgcaaggagaatggctgtctcagaagtccagctcctcacatgggtttaaacgtgttgccttttccccctgatacattttgtttaaatccatggtcatcttgccatttagtggtgtggtttaattgcatatttgggttagtctgtatgtaaacatttaacataggtgtctctgggttaaacaggaatcctattcatcttcttcaccgatatggtctgtggactctgatgagccaaatctgacatcagttctggaacatctagaagatactaaggagaacagttcagtaaggaaagaaaccaagctattttctcttttcctcatgaacattatatttagaaattaaatgttaagtgataatattatataaaaacatgattaataactataatcttagaggaattaaagtctgggtattttaagtcctccaaatcttatttactacctggtttctctttattatttcccacatgtataatcttagtttagattagcaattcgggatctctttttccctgaattctaaccattaagccaagcaagcattttgggtggagaccactagccaaggtgggaagtagaaagaagaccaaggtggaagtgaagggagagatggggagaatgacaccagaactagtgggagggaattgccttttctttcaagggtctgtaagtctgcagtaaaagtcaaaggtattcaaataggaagttttgtttttgtctttagtatataaagaagcataactttccattttgcaaaaactttagaaatcttttttcttgattataaaacttataagcaaccattattgagaagattagtaaaatataaaaaaataaaaatctcacataatttctctacctaatataagtactgttgacatgatagctagtttctatcagtatgtattgcttctttgttatcaaagtacttatacccttacagatatgtttaaatagttgaggtcatattctataaatatctataaatagctgggtgctgtggctcacacctgtaatcccagcactttgggaggccgaggcaggcagatcacaaggtcaggagtttgagaccagcctggccaatatggtgaaacctcatctctactaaaaatacaaaaattagcccggtgtggtggcaggtgactgtagtcccagctactcggcaggctgaggcaggagaattgcttgaacccaggaggcagaggtttcagtgagtcgagatcgcaccactgaggtccagcctgggtggcagagcaagactccatctaaataaataaattatgtatacacacacatacacacaccctcatatatatatacacacatatgtgtgtgtatatacacacacacacacacacacacacacacacacctacacatgaccgattgcctcgcctctagcattgggaatcagtcaccgtgctgtccttgtggagtcttgtggcccaacaagaggaagctctcccctgacattgcccctccaaagtgcgccacttccagtgcgccccactgtcatgcccggcctgtggacagccagaccctgccatccctcccacccccgaccaagcatgggggtgctctgtaggtagctgtgtggcctgacagtctctaccagtcctgctgtccctcagctgagaatcaaacccatttctggatgacagggaatgtgtcttctgctggctgtgttctctgtggagctcaggggagggaaaaggccaagctatttctagggtgctgtcaggaccgatgaaaaggtcacaccctttccaagagacacttttcctggaaagcccctggagcttagctggctcttatcctgtgataagccagaggctctggggggtgagggagcagaaaccctcctcaccccagccaacggggacctgtatacctctgccagtctctcacttggccttgctgctgtcctctgagactgcctgttcctccctctctgtgactctacaccaccatcacctcctccaggaagtcctctggattgactcctagcttattacctctttattgtgcagaccctctccattcaaagcccctcttcaactgccccccccccccactacctccaagacagagattctgggttcttgcaactgcagcccctcagagagtgtaagaggggcagaaaaaggagatcaggaggtgagggaagcagcgctgtcagagtttccaaagccccggccagcaaggcctcagaggcctctgttggagtgggggcctccctggctatgcgctccagctgcacaaggcagcctctgtgagcctctcccactcagccctacaggaagcagcagggcccagcctcaatggacccattcagaccccagcgctccggaaagtacctctgcttcctgccaccattccactctggccaaacaggctctactctcttctgatgggaggaggccgcaggcaggtggttcagtggttagggccaaccatctacttcagttcctgtctggcccagatctctgaccttgaccatgccctagtgggtgtatgtatacctttagtgcaagggtggtgtgacagttaatactgagtgtcaacttgattgggttgaaggctgcaaagtattgacctactggaagtgtctgtgagggcattgtaaaaggagataaacatttgagtcagtgggctggggaaggcagacccacctttaatactggtgggtaccatctttctaatcagctgctagcgaatataaagcaggcagaaaaacatgaaaaggtaagattggcctagcttcccagcctacatctttctcccatgctggacacttcctgccctctaacatcggactccaggttcttcagttttgagactcggattggctctccttgctcctcaaacttgcagacagcctattgtgggaccttgtgattgtgtaagttaatacttcataaactcccctttatatatctatctatatctatatctattatctatatctatatctatatctattatctatatctatatctatatctatatctatatctatatctatatctatatctatatctatatctatatctatatctgtctatatctcctattagttctgtccctctagggaaccctgattaacacaggtgggtaggcacagggagatgtgcccccttccccgtgggtgctgggtaggtaaatgtttcgcaaagggctttgttggggagagggaaccctgattttcagtatttgcctcttttcctggtataaatattcccactgtgggcagtatcacctgcctctcaaaattcctgaaaattcaacagttggctcctggcagctgctgtgagccgttccagccggtgactgtggtggctccatcctgcagggccatgtgcccccaccccttgtgctatggcctccctcactttagtgtgctgtgttttgctcttaggaatcaatgtctttgcagataaggcaccccagtagctggccgccacctgcagttccctggtctgtctcttgctggcaccaagctgtgctgtgcctgctgagactgctgggccacccccgtgcagatggtctgcggggcttgcttgattcccttagcttcccagccaaggtgctggtgttgccagcagtgctggcaggaggaggggataactagaggggatttaactcaacccgaggggctcttacgggatctttcctggatatccctccaggtgggactggctgccctgagggtatacaaacctccaactcctccaatggctgaagctacttcctcgagcagatggcagctggctcaggctggctagggaccagtgcatgtgaggtcggtgctggatcaccccatcaaggccatcagcctgtgcttgttcttggggtttgagggaaacccaacagggatgaatcacagtttttaacctgtgtttgtctgccccccagccctggacatctgcaggcaaagttaaagttatatttggctcttatcaccgcaaaaggcatagaccagaaattatggcatcgggttggaagtcagggaggctaatttggggaaactgcctggaggaagcagcaactcaaaagaggaggagtcccagtgtgggacagaacaggccctgcataagaaccactaatcccaggcaagcccagacatggccttctgcctggggaggccctctttggcctgctcagcagaccctcagccccttctaggccctgtcttcagcctcagactgagtggtggcctggggaggttgggagctgagctgttctcatccctggttccttggccacggtggaaacaatggggccggatctgactgctcagcggggactgtgaatagctctctagcaggaagcaacagcaggggtagtggaggaagtgtgggcccactttggtttgacactgcatatggtccccatctggcctgagagcctttactccttggcaaactcaggccaataagctcctgcccccaccctcaatggcagctggaagaatggcctgagggagaagcagggataggtgggctgcactgacatcacccccagatcccagccgtggccccagccaacccatggaggtggggcatggcacggcaggtgctgcacaggagcccaagcacaagggcacttaggagaaggaatctgagcagggatcgatctggcctggtggtgattctccagaaactccattcctcagggctgtgaccaccaagccaggtgatcaggccagtgatgtttccctttgggccaggtcggggagccagacctgggagggagactcctctggggcccaggggaggtgagtcagagctggcagaggcctctggctccaggaacctccaaggaggagacctgagttgctgggaatttctgggtctgacctcctgccaagtcaaggtctgggctggacacaaggtgaggctgtgccttctggtgccaggaccaaggaaatgctgggatctgggcagtgctcagaggcagcaccgtatggcagaaccatgagggtgcaccagcacggacccctttctgcaacccacccatccctccctgcagcacctcgcctcctccaggcaagaatctgagccttgaccacagctccctctctcacacagcttccttctttggttagaaccacccggaggtgactgtggccatggctctgactgacatagacctgcagctgcagttctccatgtcccaacccgaagccctccttctcctggcagcaggcccagctgaccacctcctgctgcagctctactctggacacctgcaggtgagtgacgtccccctgggattggggcgagattccttgtctagctttgagtgaaccccagctggctgttgaccttgtgtaagtcacttttcttggggtctcaagttctccactgtgggatgggcagcagcagctcagaaatggtaaatccttcatgaactggctctgcccaccggctccttccaaccatgtttcccaccacaagccctcactggccctttgtgctctgactgcactgaactgctttcagttcctggccatcttatggtcacttgctgccaggcctttggtcatcacactcctcctgccaggtgtgtgacccacccattccctgtacctgccgaactctagtctctccttgaagtttcagtgtgggcatcccctcctcctcggcgagaccccctcctgggcccccatgacccctgcgcatcctggtggcactgcaccaatttatctgcagcaccactgtctgtccatgagagtaacagcaccagtactgcctcagcttcatttttccatttcatccttcaagacaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgttgagctctgcaggtagtgatgccacatccctacagagatgcaccataccaggactccaagatcatggttcttagtgttctgcctctgcagttcccatactctgccatcacctattctagcatctgggagcaccataccagagccatttcttgtgtcaatgtcatggtgacagaactatgtccttcatctctccttgagatattcctccaccacaggtcaggcagcttttttttttttttttttttcccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttctcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtggctccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgatgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcaccttccagctccttggcaccccctctggcctccccgtggagcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccgtgtcaccggaggcctgccgttcagggagctgcagaagcagggggctggtggggtggaggatgctgagtggtgggtcacacaggcgttccaccagcaggatgtggagcagggccacgtgaggtacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacatgcctcagtggcagtggaggacaccttctgtttccatgtcacagctccaccatatttctccccactctgtaccttctccatccatattggcggtgacccagacatgcctgtcctcgtggtgcccgagggtggtgggtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccatcaggaccagagcagtggtgacgtggcctgggaggaggtatggggtgtcttctgagtggccatccagcctgtgaatgaccacgcccctatgcagaccatcagctgcgtcttccacgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgtgtgtgtgcacgtgcctcagatgtgctcccatatatgttgtgttcccaagagtttctggggagcttgctgtacacccatcctcctgggagtggtgtgtgcctctagagctggtgtccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtaccccgctctcttctcagagcccagaccaggaccaggagggtctgtcaagggcttctgctcacccaggaaccccacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccacgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcgtcagcatctgatgaactcatatgtctgtgtcactgagtctggggacatgtgattatgcacctccctgagggagtgcatctcaagctgttgaccgacaccccgtaaccatgtgtggggtgggtattaacatgtgaccagctggggcaacccagtgaaaccccatctctacacaaaacatttaaaaattagccaggcatggtggcacatgactgtggtccccagctacttgggaggctgagcccttgagcctaggacgttgaggctgcagggagctgtgatcacaccacagcactccagcctgggtgacagagtgagaccctgtctcaaaaaaacaaaaaatgtgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctgcttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtactgctggggcctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccaccccccatgtctgctttgagaaagaggccaatgtcccctacttcccggcacagatctcccccactctgagcctcagtttcctcctctgcaaaatgaggacactactgtgtgcctcacgcagttgttggaaggagagatgtgagattgtgctgaaatagaacacaggtgggaggttttgttattggacatttgcaagtacggtaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtggaggcctcagcttggcttcccaaactcctgccccttgtccacagcagagcagggcccccatttggcaaaggtggaagttgaggcccagagatgggatggaacttctccatgattgcaaaagtagttctggtggaacagaaagggcatggctttactaagcccacgtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggacgccacagaagagtgggacacagcaccctggaaccacaggctgggatggctgtgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagagtggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagctagattaaggagcactgttggtcagcgctgggggtttctgggggtgagaacttggtgacggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgggtagtgcagtgggcggtgccgggcactgaggtgcgcagcttcaagcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacggaggcatccactttggcctctctgacggtgaacatacttcctccagacacttagcttctgagtgacggcccagaagcaagtgcttcactcgctggagggcagccggacactgactgcccaggtgggtgtgctgattgtgggcgttcctgggtgcggggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggagtcatcaggctggcagggcaagttcatgttcccagaaggagggagaagaatgcaggaagtcggggatacagggccccagagcagggctggggtcttggggtgtggcttcccgaaggaagctagagctggacccaagggtctggagagggagaaccatgtaggggcactagtggcaccccagcagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaactgtgccacgggggccagcccactcatggtttaaatgaacacctctccccaaaggcagaatgggagttgttccatagcagggcagggcagggcagggcagactcttgtgggccgccctgggcaggcagcacacctgatgctcccatcaggaggctgcgtgagcatctggacccagcacatgatcacagtgagttctcggcagggagcggtcttgtggggcgcagagctgactctgtcactcaggagccacggcacacagcactgccccaagtacctccagaggggatccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggctggtgtctacagctgctgcgtaccctcagttgctgggagcctttgtcaagaatgcccaggaatgaggagggcacaggacccagaccatcagcaaccctcttgcactctatagtcccatgttactcagagcttccccatgctccagcaagatgaaggactagattgaatgggcaccaggctggcagtgccacccaggaaagctgggaagaggctacatgggctacctggcccactcagggaggagggcaggactgggtattgtcttgacagcaaccctgtcccacaacactgaactgggcagggaaggggtcaggtgtcctcatttttcagataagaaaactgaagctcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataagtcttaagtcccctcccagatctgtgacatttgacaggtgtcttttcctctggacctcggtgtccccatctgagtgagaaaaggcagtggggaggtggatcttccagtcgaagcggtatagaagcccgtgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcatgacgagatgctgcacatgcaccacgcgctgaaggaggcgctcagcatcatcggtgacatcaacaggaccactgtcaccatgcccatgcccccgcccgtggacgacacctggttgtcagagcatccctgacgaacacaggtaccaaagactgccccccacggccccaaaatcccccacccgggatgcccagaggagtgccctgggggcaagtggcacaccccctcaccggggtggctcccacctggagtgacggggggagcttgacaaggagcactggctgccggggggggggggggtgtgtggagctgggatgttctcgctgctgggggcggggcttaagctctggcaaccgccttggggtgtggccggcactgcgctggggcggggtcgcccatctctcccctccctgtgcctcccaggtcgcccaagtccagcgtcaggatgcccaggccctgccatgtccctagcccggcctgggtggcagggcccagctcctgggcggcaggacccagctcctgggcttcctcctgccgggtccgcccttggggaagcgtgccccataccctccaggccagaggcttcccctgatccctttgggccctacccccctggtgctctcgtgccccagccggggtccccaggtaagtaggggctgaatgcggctgaagaggccgctggacaggcgtggccaggaaggaaatgggactggattccagagcaccacatctggccgccagaactggccgtctccatccaaggcactgggaccatgggtgccggagccacgtgtggccgagggctggcagagcctgccccccagggatcactgagtcctggaggtggtcgtttttgaggagggggctgtggggctcgtcccacctgccgccttctgtccagcacttgcatgacacttccctctattttcactcttggcggctgcccacacgttgcatttctcttcctttcttctcgctgtcctccatcctccattccgtccaactcctagcccagtcccgggggcgcctacttcaggtctgagagtctgaactccgagatgctctgggtgtgtggatttccttcagctaccctgatgtccccacttccaagtcctgactcctttgagccatcccagggggtgtccggccactggaccacaggagcagaggcgagtctgtgactgtgtgaccagcaaggtgtgtgatgtgtgcgtgagcgagcacacgagtgtaaagaatggcacccagacctgagctaggacagagggagcctgggggccacaggcaagctcatttcttctccacacccctccccgcccgaccctgtctaaactaatggggtagtggtagccgcgagggcagggatgggagtggctgaagcctacttcactcccaaagatttctaaggaaaatggttctactgcatcctttggctgggccttgttgacccgtgaccctctttcaagaacattcactctgatttccagtgtgccgtctccactggccacgttctctaaggaagaacaatagcatctgtttttgtttccaaatggctggagagtggggctgtgggaccagcgcccatatataaaaatgaagcagggattggggcttgccctgtgatgtgctgttgaccaagttagaggggtataggcaagcagcaaagtattgggcaagatcactggactgggagtccagagatgctgcttcaccctggggctttaggcaagtccctttccctcccagagcctcagcatcccttttagcaaattatgacattctgcctttctcctaggatggctgtggggatcaagggagacagtggccatagggatgctatgttaaccgcagatgcggctgtaggagcactttgctaactgccaacgtgagttcagactcttcaggctatttggcacccaggtctatggtgaggtgtgacatatgggatgtaaagtttgatgcctgctctgactccagtcttgctaacacacacacgaaacctttggcaaatcatgaccctgccttggggaaaagggcagtctgggagagcttcttcaaggcagcctggcttcaatgcagtccggggcatgactgagataggcatacgttgtgaggaactggagggtaactgggtaaagagctgcagtgtgggcagaggtgtagtgtgggtcacattgaggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctcttaggtggagaaatgacagccggacattagtgagcaagccctgtctccctgagcaggatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgcggcacgtgccggctggtgagggtgttgggcaccgggaggtggcggagagggcgacgtatgcgtgttgtttgtgggcatgtgttagagtgtgcatgcgggccgtggggcctcacagcatgtgtgtgcacaatctggcgtgtgcgtgtgtccgccacccccaggcctgccccacccatgcatgggacctgccatgtgatttgatgctgtctttcagaatcactatcagtggcccctgaggagcatcagccatggtaggtacatgcctcactgcctgctgcatgaatggtctgcccgccccgctgccccagctccacacagggggcatacctggagcctcagagccaggctgcctgcccctcccttctagagctgcagccttgctctttcctctttctgtccttgtgctgctggctgtctcacttccctccctgccagccacaggactcagtgccactgctcaaggtctccatggctgagcctgggggctcttacaacaggctccatgccgaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccgagagccaaatccactgcagattaggggtgatagtcacggtcccacgtcctctatctgtcagcaatccagtggtgatctaggataaaagcctgagagtcctatacacgcggtcatcccacaacacacttcataggccatgcaaggacacacagcccccttccctccctcccaggtaccatcacagctgctagcatgtgactgaaggctgggtccctggccagcactactgaagcactactgccagccagcaggctcacggaccttggcctgttgctcctaggggtcacctgtgctattcagccaaggagaccacagtgcttgctggcccagctgagctccgcctagcgagcccacctgcctttcctgccgcggagtctccctcttctgcttttcccagcaggaagggcccagcctcacctatgcaacctgcagccccccgccaaccagttgaggttcccctcttagacttataagtctatgggcagtggcatctagctacctgccctccctgccttccccagggtcccttcagtggaccctgggctttctgactgcccagagaggggcctctggcgctcactccagccagccatcccttacagcttcaccattttggttcaagcagtgttccttctgtcaggcttggtggctgttgggtggggctccccaagcaagaggtggccctgggccagtgggttggaagatggggtgaccacagaagagggaagccgggggagttgagcattggtctgaactgtgggtggactgcctgggtgccatgagagaggccagtgtgtgtggggtggggaggaccgccacagcccccaggcactacctatgaagctctagcttctccctccatcttcctcccctttcccttccagcccctcttttccaggaaccttgccacgcccacacctacgccttccccttcccggctctcagatgatggtggtgtttatctccctgttcttgggagcccaaaaagaatggcatgcaggggttgctgcccatgcctgggtgctcctggggagtcctgcattacaggaagcagctgctggatctgctgtgcagtggggttgtcgtggggagaaccctccctgtcctctcctggtgcagcctccacgctatcagtgaggctcacctcacaaagatcttcagagagagggagggggggtgggaatctgagcacagtgtgagcctcccctgctcctgcctgcccaccccgcctgagggctctactcaccaccctgctcgtcagcacacccaagctcctgggctattggggctcctagagtgggctcatcagcagggttctgggcaatggtcagaatttgccatgcccctccttgtggtctcccacaagctgcaacacctgccccgcagctcctgcaggttcacctggaggaaggggtgttagctgccatgccggtgccagcacgcacgttcacacccacccccaccctcccccaccgagatgttgcacaccctaccttcatctcctcctggtcctgggccagcctgacgatgtcctcctctcccagtgctgcgtctctgacactgccccctggctgatgtactttcctgcaggaggacatggctcagatgctggggcccctcagacggcctggcagctccccccagcggtgccctagcctctcactccctatggtgtctgtctgtcctgagaggtggatgaattgaagctctagtttctctacccgctccttcaggtccaccttctccttccataaagtcgctgtggagccaaaataatggggtcacatgtcaggagtcacctgccttgtcctgcccccccgccccccttgttggcccatgccaggacctactcacctgcagcttctccatggccccctgcagggcccggtgggtctccccaaacacagactcacccccactctctggggctggggccgctacctctggctttttctgggacgaggccactgggtgagccaggggctggcagcacaccctttgttcctcctgggcattggctccagcggagttgaaaaatgccacctgaagacaagaggtgagtattcttgtaggggtatacacataacaactggggcaggcagatggagcatagccccttcatttcgggcctcacagagtgcacctgttggtcacaggtgaaatggtgtctgaccactggctcccagaagcagagaaagtccacagaagtcagaaggcggggaaaccaagaacataagggggtttcggagggaccacagaggaaggtggcaaagtaggggcagggaaagtcaggctcaccatggcctcccggctctccaggtcccctgggatgttcggcatgggccgaagcgcctcctgctcactgtccagatgtcctcctccatctcctgtggggggtggccagaggggtcctcagacaacccaacaagggaggtacagtgggcccgcctctgcccccacactcactgtgtaaccttgagccagcccctccccagaggggaatgagctgttctttattttgaattttaagaaccaagatcttgctatattgcccaggcacagtcccactaccgattggtgcaggaattctgacctgctccctttctgacctgggccagttctcccatccttaggcaagccgatgacctgttcccaggaggtcaccatactgatactgaacttagtgcggacaccttgtcggcataatgaccgacacaaaatgcttaaaaggtaacctgactctttgttcagggctcagtcctttagatgttaatctgactgggccggtgcacctaaataatatatatcctcctcagtctctctgattcctaaattatgctgctgtacggggagagaggcagcagggtagtggagtcataccaagcaacaagacagggtagtggccaggcatggtggctcacacctgtaatcccagcaatttgggaggccaaggcgggtggatcacctgaggtcaggagttcgagaccagcctggccaacatgatgaaaccccatctctactaaaaacacaaaaattagctgggcatggtggcaggtgcctgtaatcccagctactcaggaggctgaggcaggagaattgcttgaacccaggagatggaagttgcagtaagccaagattgtgccattgcactccagccagggggacaagagggagacttcacctcgaaagacagacagacaggctagtacgttttccacaaatttcaattttactctcttcccccaccacacacacacacacacacaaagcatttgagggatgggaggaagaaactgagatcacagggaaaattgtaagagacattcagaaggacaggtcttagaaatttactagtttgggggggaggtcagaacaggtgtatataaaagaatattaagacagttcccaggtttaggcatatgtgactagatagagtgctaggagatggatacgtgaaaatttaaatatcatcattttgaacacccatgtcactccaagtgagattccctaaatatatgatatacagacagatatatgggtttgaaactctggagatgaatacaaatttaggagtccctggaacacaggtcatgacttaagtaatgggagtcaaagattactcagagaaagcacagaatgagaagagaagaagtaggacaaggaagaagagatcggaggagaccaagaaagggtgataagatcaaaacaggagaaaagaatccgacagaagtctcatttgattatcatgtcccttcccagaggacagggacatgtcttttttgtcttttatacccaattatcacaggtcctggtgcagcagacacacagtttttttttttttaattgtgttgtactactcacagtttcctgtattcaccaggggagaaaaaagtaagtataaagaagcacagacacagatgtttttacactgtgtactaaaggggtcagattatacacaatattttatgccttacttttttacttaatatatcttagaagtttgcacgtgctcttatggaaagactggctgcattttttggtccacaacagaacaacagaatattataaaacggtacactataatttttatttaaccaactctttattggtggacattaagaatggaggaatgtttcaacaaaggaacaatcaacagtatcaaaatactgcagaggggacaatttggggactaagaggggagccactggatttgacaactaggagataaattttagtgcaacgatgaaggcagaatccagagtataatgagctcagtgaaaaaaggtgaagacatgtagcttattctctcaagaaactaggctatgataaactggcagaggctctaagagtgggaggtgagttgttttctccttcatgtaaatatatttaccttttaaacactaggcccaattttatatcctatttcatttaactttatgaacatatttatgtatgtatgcatgtatgtatgtatctcatgtggtgttttagacactgaaaaataactcatttctattataaaactgatatctttagatgttcagaagcaacttcctaaaaggaggtagcagtaatggagctatgtctatcattctttcccatcaacccccttgatggagatgtaaacatgtgtccatcaagcctttaatttttacctcttatcttcatggctctccatataaaacttaactcttttttttttctatttgtatacgtatatttatatgtatatctatatcgagagagagagagagagaaagagtcttgctatgttgcccaggctgatctcaaactcctgggctcaagcaatcctcccaccttggcctcgcaaagtgctgggattacaggcgtgaaccactgtgcccagcctcagccttaactcttaaaatatcttcaaaccaatattcttctgttctaatttttaagaatagatgtgtttaaaccaactaacttattttgacaaaaattggagttaagactcagacttcctcaaatagttctcctaaaaccatttacagaataatctatcttttcagtattaagttaaaataccaccttttccttatactaaattctcgtttgcatgactctggttctaaacttccattgcctttatctgtctggcccagggatagtccacaatattttatttactatctggttgaaagagtctatactttattactttttattacttattcttctaaacaaattttagagtcgttttgtcaagtgtcaaaaataaatctgccagaatttgtactgaaatttgtgtgtgtgtgtatatatatataatacacacacactatatataaaatataaaatgtatatatacaatttatatatataaatatttataaaatatgaaatatatatatatacacacacacttttctagtttttttttttttttttttttttgagacagggtctcactctgtcacctaggctggagttcagaggcatgatctcggctcactgcaacctctgcctcccaggctcaagtgctcctcccacctcagcctcagaagtagttggaaatacaagtgtgtgccacagacacccagctaattgtcatctacccgcctcagcttcccaaactgtttggattacaggtatgagccactgtgcccagcagaaattacatttacaaattaatatgaagacatggtgataactaacatatttataacatgaaatctgctcatccaggaacatagaatgcaaatctttcattccactcagcaaaattttgtcctgtccttgataaaagtcctgcacatctaagtttattcctaggcatttaatttttgctgaaatacctgaaaaaatacttcatcactatatcttctatgtgattatagctaacattggggaaggctattgatttttatataaaagaacttttaaccagtaatcttaaaaattgttttttctcagttggttcctttggatatttttaggtaaacaatcatgtcaactgaaaataatgattatttttctataaagactatgacatcacaggaaaatacagtaaatactttttaaaagaatataaaagggccaggcacagtggctcacgcctgtaatcccagcactttgggaggccaaggtgggcagaccatgaggtcaggagatcgagaccatcctggctaacacggtggaaccccatctctactaaaaaatacaaaaaattagccgggaatggtggcgggcgcctgtagtcccagctactggggaggctgaggcaggagaatggtgggaacccaggaggtggagcttgcagtgagccgagaccacggcactgcactccagcctgggtgacagagcaagactctgtctcaaaaaaaaaaaaaaaaaaaaaatatatatatatatatatatatataaaactatagagaatatgacctcaactattaagcatatgtgtaagggttatgtattttaatagcaaagaaaaaatatatactggtagaaaatgaccatcatgtcaacagtcaatagtggttatattagatagagaaattatgggagactttaatttttttcttttatcttttctgtactttaccaattttctcaacaatggttgcttatgagttttaaaattaaaaaaaggttttaaaaatttttccaacatggaaagttatatttctttatatactaaaacaaaaacaaaactttctatttgaatacctatggcaaaaccctatctctacaaaaaatacaaaaaattagcaaggtggggtagtacacacctgtagtcccagctactctagaggctgaggtgggaggatcacctgagtccccagagaatgaggctccagtgagccgtgatcatagcactgcattccagcctgggagacagagaaagaccccatctcaaaaaaaaaaaaaaaagaaagaaagaaagaaaaaagaaatatccacaatgatctgaaatgcctatctgtatgagactgtcctttgttcacattttttcaagcaaatatcacacaataaattgaatgcaggtacaaatgacatatcaaacatcaaagaaatttgcaaaagatgtaagactgtactaccttgggtttagaaattttcttatcataaaagcatttataacaatattttgtgagcttttaaggaatattttaagtatttctgatttaatttctagtgataaataccaatagatataacccacatacacaaaagctccttgggccctcaatatacttttaagagtgtaaaggaatcctgaccccaaaactttgagaactgctgccttcccctctactttattccttccctagaatttcttccttggaagaaacattcctttgccattctatgttaacttacacagttccattgaggccagttttgctacctctctcccatctttccacatccctctcttgacacaaaacctgaccaaaggactctaccggcccgccccatttccagtgattagctgtcaggtgggctaagccaagaaaatctgggttttccctgagactagacctctctttctgggagatacggaatcacagggacaaggctggccctgtcagaattcatcttgtctaaatgggaagaggttaggcaagtttctagaatgccagactgctttctagaaagtcaaagataattatactttctgccacgactgtgaaaatgcccatttcattgcacgctttctaacatttataccaatctgataaataaaagctggtacctagaagaaaaaaaggctgggtatggtggctcatgcctgtaatcccagtactttgggagaccaaggtgagtggatcacctgaggtcaggagttcgagacaagcctggccaacatgatgaaaccccatctctagtaaaaacacaaacattagccgggcatggtggcaggcccctgtaatcccaactactcgggaggctgaggcaagaggatcacttgaacctgggaggtggaggttttagtgagccaagatcatgccattgccctccagcctgggtgacaagctgagactttgtctcaaaaaaaaaaaaaaaaaaaaaagtttccatacaatataatttgttccatctctaaaaaccaattcagcaataactgaaagccaccacttggaaggtttcaaggatttagctctacctgttgatgatgtccaaagcattagttaaggtagaaaaaaaatacacacacacacacacacacacacacacacacactcacccctatgtagtcagtaccaggaaacacgaaagactagatggtacagtcatccaacacaaagcacacaataactgaaggcactgtagaggagtaacttatgacacagatctacaatattgagtgaaaatgcagattacaaaaaaaaaatctgattttttaagggagagggaacacatacaagcaaaggagaaaagagatgagcagatgactgaaagatacaaaattctgatagtggtacattctgagtggtagaattatcagtattattttctagttttgcctaaaaattttctaaatttcttaagaactttttgttatccatattatcaaatatccatcaccccaggaaacttaaccttgagcacaaactctacaacaagttcaatgtttgttcagtttaatatttaagagacaacctattttgaaagacatctaaaatgatgaccaatatttaaacctatgcattaatatttttcaatcatatccttcacattttgtaattttgataaggttaagctttagatccatcttgaaaagataagctttctgtttgtctttaaaatatgacccacaatatgcctgtttttaaacagtgaatgatgctctaaaatcacaatataaattcaggcagtgctccttacatggaaagtttaagtacttctaacactgctctttttcacttgttatgaaaacacagaacaattatctaagcatctaattattcaggtcctttgtttctcctccaatctattagttttatagtaattttagggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttccgtacctatttttctccataaatccactgagaccaatgtgtggctctatcgcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattattctgaaggctggttacgggacacattaccttcatactttgctgtttaagaaatgtggggtggagaatcaagtaaactgatagaatttccatataaaattctaagtgctctgagaacaaaagaaacttaaaatacacacacacacacacacacacacacacacacacggttttccctactaatcattttaaactaaacaaccaagttgctaaaccagagcccacaaaagcagagtcaaagttctaacacttggtaaaagaaaaatgcacacatacccctgtgagctaaaaaaaaaatgcttaagtattcaaagacagcaattacagctactgagaacatcactgtaagcaaactgaggcagagaaaacaaacgtgctgatgaggatttgaaccacctaagctgcagaaacccactggatggtttcctaggttccgagttggcattatctttcagaacaatcttctagaagagatcacataacactgttacaaaggatctggagaaagggaccctggcttcatcactgtggctctccagtcatgctttacatttggcagtgactatctccattcaactcaattccctaaccctgaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggagcagaaagtttaatagacaagaaagaagaaaggctccctgcggtacagaaaaagggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcaggaggctgaggcaggagattcacttgaacctgggaggcagaggctgcagtgagctgagatcacaccactgcactccagcctgggtgacagagcgagattccgtctccaaaaaaaagataaaaagaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcctaactactaaataaaagctaaactactcacttcctcctagattcagagagagctccaacattttctaaaatttggtatcttgttgttggggtaggcactttttggcaataatgaatagacatttaattagccaatcaaaaaaacttattaggtacagtaagttcctcttcaaaggtttaacctgttcaacttccttgttctttgttcctaagaacaatttccctgtaccttctcacccctatttacctgcttagttatctgctcagttacctgccttgtaaacaactcttcccatcagtcccaacctgtaactcacattccctctcccttccttattagggagaatattcgcgatagcaaatcaagtctgcttagattgtgtagtccgactccagcccatgtgggaatgacagagaggtagggactgcgttagggatataaactcctgctctatcccgctcggtgtgctcttgcattcgtgactaatgcaaacagcagtcttttgcagaagtaagttgtcttgctgagaaaactttttttcctgagtgctggttcttccttgcagcactgatcatttgtttcttttttctttctttttttttttttttttgagacagagtttcgctctgttgcccagggtggagcacagtggcttgatctcagctcactgcaagctccacctcccaggttcacgccattctcctgcctcagcctcctgagtagctgggactacaggcacccaccactgcgcccagctaatttttttgtatttttttttttttagtagagacggcatttcaccatgttagccaggatggtctcgatctcctgacttcatgatccgcccacctcggcctcccaaagtgctgggattacaggggcgagccactgcgcccagcctgatcatttgtttctaacaatctgggggctcgtccggaattcccattctcctctgagaaaagggtctccagtcaccaatagtgaggagaagcatcccactgcctcattgaggtggcctcatggtgagggatcaggacccacccagtgtgatgaataaacccggactctcagcagtctggaaaggaacagaccaacaacttaagagaaaaggatcctcacataccatggtgaccaggtaactatgtgcacagaccaacgtaagaaacatcacaagagcgacaaagtattttcttggtggttgggatatcttggagattgaaagtgtgtgttgagactcacaattgagtgcaaagcaagtgttcagtccagatctgcagttctgtggtcaccttatacagcttaaggtagcccttctgtaaaggagtctgggtcaggggtttctactgaaacagccattgctaagaggaaaccaacgttcccgtgagggaagcagccagagaaggatgaagcgaaaggagaaaagtgcaagaaacctccagcaggggggttgagcctcggaaaggaaagggaaaggaaagggaaagggaaagggaaaggaaaggaaagggaaaggaaaggaaaggaaagggaaaggaaaggaaagggaaaggaaaggaaagggaaagggaagggaaagggaagggaaagagaagggaaagggaagggaagggaagggaagggaagggaagggaagggaagggaagggaaggaaaggaaaggtgagaaatctccagtaggagaggttgagccttatacaaacctctcgtaactgggaagaaatttctagtaggggaaattgagcctcaccccaatcccttttcaagatgggaaatacctcaagtaatgcaggggagaaaaaggataaagctagcaacaataacattcctcctgatagtcccctagggcttatgctaaaatattgaaaagagagtgaaaggactaaatacaagaaaaagcagcaaatgataaaatattgttgtttcatttggactcaggaatcaatcctgaaaagcaagtcagaaattaactcctctgagaaagataaggtccctgttcctagacagctcaccaacacatggaacttcctccaccaccttcccccgtccaatatccctaacctccttccccctcaagcagaagcagttgtcccagacccttctcctacccacattgttccccctctttataaccctgcctcttgggaattgtcccaacagcctgctcactatcaccctaagtactcttccctgaaaggacttcagtgtgagatagagcaatgtaaaagggatattcagaacttccccttcccctctacctcgggagaattagctccacctctcttcccctgaagagaggtgtccctacgaggaggaggtattcactttgtaaatgctcctttaaccagctcggaggtccaaaacctaaaaacagagttcaagccacactattagacaactccagtggaatagcagatcgaattaaccaatttctaggaccacagttatatatacttgggctgagttaatgtccatcctaggcatccttttctcaggggaagaaagaagcatcatctgtagagctgctatggtagcctgggaacatgaacaccctcctggccaaaacattcatgcagcggatcaaaaattccccaaccaagacccctgctgggacaataataacgcagcccactgaagaggatacgcaagaacttagggaaatgataataaaagggattcgggagtcagtactccgaacccaaaatcttactcgagcattcgacatacaacaaaggaaagatgaagggcctatcgaacttttagacaggttgaaagaacaaatgagaaaatatgctggcctagatttagaagatcctcttaggcagtgaatgttaaagcttcattttgttactaacagccagatatcacaaggaaattacaaaagataggaaattggaaggaccatcccacgaacgagcttcttagagaagctcagaaagtgtgtgtaaggagggatgaggagaagcaaaaagaaaaaatgaaaattatgttatccaccttccaacagggggccccaaaggataaaacacaccagtattactctctgttacccagagacccacacactcccaaacaaagcctcccgagagccaaaacctataaagatcctaggcccccacttcctaagccatataaagaacataaggagacaaagccgagaaacccaaaaatagagagaagagacagaatcaatgcttcaattgtgagaaagtaggccacttcaagaggtattgtcccaaattaaaatcagaaagagaagtcgtcccacttacgacctttgaggaggaataggggggttaggggctctgtctcttttaccttgaatcccaccaagagcccttgataaatttagaagtggaacccaaatccgagcttatgacctttttagtagactcaggagcagcctgctcctctgtttgttaccttcccccacaatataacctggtcctcagaggagcttgtagtctcaggggtaaaaggagagggaatcaaactaaaaattttaaaagaaacagaaattagatgtaaaaactgctcagctaatgttgaatttttgttaatttcagaggcaggaactaatctattaggaagaaacttaatgttaaaattaggtataggtttacgtattggctcagaaggattctacacttcattaaacctgctcaccactgcagaagaaacatacattcatcctgatgtttgggcaagggaaggaaattggggaaaactccaaattccccctatacatataaagttaaaaacccctggagaaatagtaagaagaaagcaatatcctattcctttagaaggcagaataggcctgaaacctgtaattgaaagcctcatcaaggatgggctccttgaaccctgtatgtccccttataacaccccaatactgcctgtgaagaaaccagataggtcatgtcgactagcataagacctctgggccatcaaccagacagtctagactacccatcctgttgtccctaatccttaaaccattctcagtaaaattccatatgaacatcaatggtttacagtaataggtttaaaagatgccttttgagcatgctccttggatgaggacagctgagacatttttgctttcgaatgggaagatccccattctggatgacagcaacagtatcgatagacagttctaccccagggcttcacagattcccctaatctctttggtcaaattctagaacaagtgttagaacaagtttataccccaaaatgtatatgtctgctccagtacgtagatgacttattaatatccggttaggctatagaaaaggtatctgctttctccgtccatatccttaaccatttgtaaggagaggggctatgggtttcaaagagaaagcttcgattcatagagcctgaagttaaatacctaggacacttaataagtaacggcaaacgaaggatagggcctgagagggttgaaaggattgtatccatacctttgcttaagactaaacaagaactcagaaaattcctagggatagctggatattgccgcttatggattgactcatatgcccttgtcataaagcctctctacctaaaaatcacccaagaaaagcctgaccctctcctctggacttctgaagaactccaccaggttgaggagctaaaacatctgcttataactgcctctgttttagctttgccttccctagaaaagccatttcacctttctgttaacataaataagggggtagctttaggggtccttacccaagaacacggaggtcaccagcaacccatggatctcctatccaaaagttttagatccagtaacctgtggatggcctgaatgtttcaatccattgcagctaccgccttgttaactaaagaaagcagaaaactaacctttgggggaaagttagttgtaaacatgccccatcaggttagagccatcttaaattaaaaggcaggaaggtggcttactgacttgagaattttaaagtatgaagctatcctgttagaaagagatgatttaacactaaccactgataattcacttaacccagaggtttcctgactggagatccaaatctaaagagacctgagcatgagtgtttagatttaatgatcatacaaaagttaggcctgatttaagagagaccccttacaaaacggggcagggcttctttatagatggctcttcccaagtaattgaaggaaaaaggcgtaataggtactcagtagtagatggggaggcacttgaagaagtagagtcaggaagcctgccaaataattggtctgcccaaacatgtgaatgaattgtttgcattaaatcaagccttaaagcacttgcaaaaccaagaacggactatttatactgattccaagtatgcctttggggtagctcacacctttggaaaaatttggactgaacgagatcttattaatagcaaaggccaagacctgggccacaaagaattaatcacccaagtattagataacctgcagctgccagaatagctattgtccatgttccaggacatcagaaaagtctttcttttcaaagcggaaggaataacctagcagatcaaatagccaaacacactgccgtttcctctgaaaatgcctgtttttcacttagccccttgccttcctccctcgactgcagtccccatcttttctcccgctgaaaaggaaaaattaataaaaataggagccaaagaaaattcagaagggaaatgggtgtcaccagaccaaagagaaatgttatccaaacccctcatgagggaaattctctcccatctgcatcaagggactcattagggacctcaagctaagtgtgatgcagtcctcggggtctacagatgtataggaatttatattttggcaagacaagttacagatagttgcctagtatgtaagaagactaataagcagatcctcagaaaaccacctgttggagggagaaatccaggattaaggctgttccaaagtgtccaaattgattatgctgaaatgcccccaattggtcacttaaaatatttattagtgatagatcaccttactcattgggtagaagctattcccttttcaagtgcaactgctagtaatgtactcaaggcattagttgaaaatattatacccaggtttggattaatagaaaatgctgattcagacaataggactcatttcactgcacatgttcttaagaaactagcccaagtactagatataacatgggactaccataacccctggcacccaccttcatcaggaagagtagaaagaatgaatcagactctgaaaaaccacctaaccaaattagtcctagagacttggttgccatggactaaatgcctccccatggtcttgtgaagattccaaactgcccctaggaaagatgtcggctcacctccttatgaaatgctgtatgagttgccttatctacactccactgctgacattcctcgttcgaaacaaaagatctgtttctcaagaactatatacttggtctatcctccactttctctttccttaggactaaaggcctcttggcacatacaccaccccttgaatttccagttcaccaccaccagcccggacagtgaccacattctcatcaaaggtcagaaagaaaggaagctcaagcccacctgggagggacattatctagtgtttctaatgactgagacagccgtccacaccactgaaaaagaatggactcaccatacctgagtcaaaagagcaccacccactccagaatcatggacagctatttcagggccaattccaaccaagttaaagctaaaacgggtttgatcctcttatgctatatttcttttccccttctattgctagtcctctcgttattaatgtaactaggtcgagctcaccccaaactattacctttgatgcttgccttgttatatcctgtggagatctccaaagtcaaaagcaactctcagcctcagagaagtatctccgtccctttcagacaaaagcctcccccattacgactcttgttccttaagaaatgtagggaaacaggcctgccacagctggaatgatattatgtggacaactgaacatcagggcttggtcaacaggcagttgtaagtctctaaaaccatgtttgctttgttaaaggaaacattccccaccccctgactgccagtataaccaatgtaatccagtgcaaatttctattcttatccccacttctgccaaccctaaacctactttaagtcgcttatacggcataggagccaaaatagcagggacacatcttatagaatcctttgaaatgcatttcattactttctcacctcctccacctccttctacactctctctcaacgaaaccgctgttcttccttcaaccaaggataaaatcaaggtaagccattgtagaagttaaaaatttgaaacaaaccatagcaactgagacagggtaccaagatgcaagtgcttggttagaatggattaaatattctgtccgcactctaaacaaaagcaactgttacacttgtgcgcacagtaggccagaggcccaggttgtcccctttccactcggatggtcttccagccaactgggcatgagctgtatggtagctcttctccaagaccccacagcctggggtaatgaatcttgccaagctctctctctgctattccctaaagtccaacaccctgcaggtcagtccctgagggccatccagcctccatctattgacaccaatttttacctcgggtctctcacaacaaggggaaaacttggcatttcatgaagacctaaagggatgcggtgaacttaaactctcccaagagcttaccagtcagtctgcccttgttcatcctcgagcatacgtatggtggtattgtggtggacccttactggacactctgccaagtaactggagtggtacttgtgctctagtccaactggccatccctttcaccctagcattccattaacataatagaagagaaaatcagaagagaagaagtgaccttcatgggtcctttgactcccacgtttataaagatgctactggagttccacgaggggtaccagataaatttaaggcccgaaatcaaacagcttcaggatttgaatctgtgctgttttggtggtcaactgtaaataaaaatgtagatcggataaactacatttattacaaccaacaaaggtttgttaactacacaagacatgccattaagggaacagcctcccaattaggtcccattaactaaatagtctgggaaaacaggatagccctagatacgatgctagcagaaaaaggtggtgtctgtgtcatgattggagtccaatgatgtacttttattcctaataacacagcccctgacggaacagtaacaaaagctttgcaggacctaacctccttatccaatgagttagcaagcaattctggaataaatgatccctttacaagtttaatggagaaatggtctggaaaatggaaaggcttaatgtcctcaatatttacttctcttgcaatcgttataggtgtgcttattcttgttggatgctgtatcataccatacatttgtggactactgcaaagactcatagacacagaacttaccaaaacctctcttagctctcctccaccctattcagataagcttttccttctagaaaaccaagcagaacagcaaagcaaagacatgctaaaaaagtttgaagaggaagaattacaaaaattaagaggggggaattgttaggtacagtaagttcctcttcaaaggtttaacttgttcaacttccttgttctctgttcctaagaacaatttccctgtaccttctcgaccctacttaccagcttagttacctgcttagtaacctgccttgtaaacaactcttcctaccagccccaatctgtaactcacattccccctccctttcttattagagaaaatattcacaatatccagctgagtcagctaagattgtgcagtcctaccccagcccatgttggaatgacacagaggtagggagtgcattagggataagaacccctgctccaccccgtttggtgtgctcttgcaatcatgactaatgcaagcagcatacttgcagaagcaaattgtcttgctgagaaaacttttttgcctgagtgctgcttcttcctcacagcaccaatcatttgtttctaacaatctcgctaaaagcagcctagaaagcagccacttatgcagaaagagtaataatttatgctctacaagtcatataaaaaatgaagtttcatttgtttaccggctaatttacttcctgggagacatttttcattctaaaacagtgattccctaccaagagttcatagatgccaagaagtccataaaaggcgtaatggaattgccaaattatgttaaatacttcaaaaggactcaaagccatatactagttcccaataggcctgcacaagttattagaacaagctgctttgcattcttgtgtgatcagaaccagtaactagatggcaatcaggtctgttactgaagatggaaaaactatacttaagtttgtataacaatctttcataacatggcttcacagaaaagaagtataaaaaggattccttggttgaaaaagagtgctcttttcccttcattatttaagattaggacaaatttataaaacaggaaaaaaatagcacaaatcccttggcaaacagagtaaaacatctactctgttttgctttttttcacttcttacactctctttcataggaagtcaatttacagacttccatcaagcccttagagacctttttgtactatccatgacaagctcttgatgttatctctgcacttttgacaaattcttagcagttaacttacaaggcagttaagatttttgttcaagcacaatatagctagaataggctcatacattcaataaaacaaatatttaccaagcatttattgagtggaagataaaaagcacaaagcataattataaaatattttcccctgccaccataaaaaaattaaacaggcttacagaatacagtgtaagaaaacatgaccaaagcaaaaatagtaaggactaaagaagggaggaaggggaaatatcaacatggactgaatatgacccaaaagagccttgatggatggtcagacatgtaaaggcaaattggttagggttaaggggtggaggtcagggcacgttctatagggaaacggcagctgatacagaagcctgaaaggaaaagcgggcagagcacctggacaggactcttcaggaacgagcacgcacgtgcgtgaaaaacaacttagtgaggtaccgttcacccaaacattagagaaaccgcgtaaaaatgcttcttggtaagcatgaagaaggcagggctcgccctgtagaagaactcaataaacatttgaactgtctaaagagtaaaagttaatgaataggccaaactcactcctttctttgttttaagagctacaactttagagaataacaaatcacaaacccagtagacaggtcctggcatttcaaatccaaccccatttttcccttaatctttcccctctgagcaaatggtatcgacatgaacaagccatgttgatttgatcaagacactcaaccatggttaaaagagtctttaccttcaagagatacaaacagaaatattgacagatgaagtgatctgtctggaatctgcttcaaaataatccaaagtggagtataaatgaaataagattagccaaaagtttatcattgttgagggtggctacagtacatagttcaacttttgttgaggccaggcatggtggctcacacctgtaatcccaacactttgtgaagtggaggcagaaggatcacttagcccaggagttcgagaccagcccgggaaacacagggagacaccgtctctccaaaaaaaaaaaaaaaaaaaaaaaaaattagccaccatgatggtgagtgctacttgtgaggctgaggtagaaggatcacttgagcctgggaggtcaaggctgcactaagctgtgattgtgccactgcacttcagcctggacaaaagagtgagactctgtctcaaaacaaaaaacaaaaaaaaaaaaaaaaagaaagatggaacatattataactgtcagaccatttgttgcaacctgggctgcaatctttttctttaaacccaaaagaacttctgaccaggtaaatgtagtctttttttcttttttaatgacaaatctactttataaagtaccttcccttatcagtgagaaagaaaatataaaagagctgagtcaaatctggagtcaataaaggtttgtagttcttcaaacaagaacccttgctctgaattctaaaagtaaataacagacatgctgaaaaaatatttcattttatgaaaggttctgcaccaaagccttttacaaaaacagtctacaaaacctactaaacatcctgttccatcttccactttgaaatcacttgcttggtctaaattcagtttcattaataaaaatgaacacaataaaacagtactctatgcccccattccaccccaacaattatcttcaaaggatgtccagatttctgtacgctatttgccaatcctacctacatattaaaaaaacaaatctcagctttagaggaaaatcactggttaattaaaatgtcatttagggttgtatttgttttctatgaagggataataatgggatattttattttcatttattactaaagcaacacctttcattattagaaatgtatttccatttcaagctacgtttcaaagcaaattatattcttcaactagccactttcataggtattttgaatgcaatattttattataaagccttggctggcctccagtgttaattagcacaaaaagatgggtttattttcaaaagacaggacattcttttcagccttcaaaatgttttcatcaaaaattactatgtaccataaaaataacacgctcactgtaaacatttaagcgattcaaagataaagtagaaagtcaaagtctccacctacctgccctctaagatgttaatacttatgcttaacatattttattttttaaaaggaggggaaatcacatcataactactttaaaaggcctttacaacttctttgtaattacacacacacacacacacacacacacacacacacacacagagtggggaaggagagggagggggtgggggaaggagggagggacagacagacacatacacttcaatgtaaggcttattataaaacgtacaaaaaaggcgagaaaacagagatgggtgggagacgggcctgcaatttcaatatctgaagtcaaaacaacttattaggagataatttagaatgcttcctgtcaaccctatttggggaaaatattgatttgataaaaggttacggactgaaatcaaaaagtagctgccttttgaaggtcaattaatcctttggttttaggataaactaaaatgttacaaaacacacacagtgaaacacacagagaactcaaactgacctaactacatttatcctctccttcccaattatcctttatcactaatttccccaaactactactctattagtttcctattgctgttaacaacaaattatcacaaactcagtggcttaagacaacacaaatttattatcatgttatcatttctggaagtcaaaagtccaaaatgactttcacttgtttaaaaatcaaagtgccagcagggctgtgttccttctagagtctctatgtggagaaagtgttcttttgctatttccagcttctagagctgcattctgtggctcatgggctccttcctccatgttctaagccagcagtgtagcatcttcaatcacctgacaaaatccaacacgttttcatcataaaaatggtcaaagtaggaatagaagggaacgtcctcatctaacaaaaggtacctgtgaaaaacccacacctaacaacatcatacttaatggggaaagcttggatgctttctctttcagatcagtagcaagacaaggatgtttgtgctcaccacttctattcaatgttgtaccagagatgcttctcagggcgattaggcaagaaaaagaaataaaaggcatccagattggaaaggaagaaaacgatctccaactacttcatcctgtacatagaaaatcctaaggcatccacttaagagctgttgccaaacaaacaagccagattatagtctataattgacctctgaaacaaggctacagtttcagagaccggtatgcaaaaatcaatagtatttctatatataatcaatgaacaatcaaaaactgaacaattaagataacaaaattaacaatcgcatcaaaatgaataaaatcataagcaacaaatttcaagaaagtaccaagtttatacaatgaacactacaaaacactgttgaaagaaatcaaagacaacctaaatgaaaggaatcaaattcagcatccagaaaaaattcctcacatttatgatcaatttcaacaacgatgcccaagacaattcaattggggaaagaacagtcttttcaacaaatgcttctggaacatctagagatccacatgcaaaagaaaaaagttggactcttcccttacaaaacacacaaaaatgaactctcacattacatacctaaatgtaagagctaaacctataaaatttctagaagaaaacataggagtaaatctctgtgactctgggttaggcaaagaattgttcttagatatgatgccaaaaaaaaatcaacaacagaacattatcaaaactgaaaattttgcttgaaaggatagcatcaaggaagtgaaatgacaacccacagaatgagagataatttttgcaaatcatgtatctgataagggacctgtagtcagaatatgcaaagaacccttacaattcaataagacaacccaatttaaaaacaggcaaaggatgtgaataggcatttctccaaagatacggaaaaacggccaataagcacataaaaagatgctcaaaatcatttgccatttgggaaatgcaatcaaaaccacaatgaggtatcacttcacgcccattagggtggctatagatcagaaagtcagataacatgtgttggcaagcacatggaaacactgaagtccttacacactgctggtaggaatgtaaaatggtgcagccactgtggaaaacagttttccaatttctcaaaatgttaaacacagttatcatacacccaagcaattctactcttaggtatatacccaagagaaatgaaaacatatgtcttcaccagaacttgctgttcacagcagcattatgcataatagaccaaaagtggaaacaactcaactgcccatcaactggtgaatggataagtaaaatgtgatgtaaccagtcattggactgtcattcattaataaaaagaacaaggtactgattcatgttctaacatgagtgaatcttgaaaacactatgctaaattaaagaagccagtcacaaaaggccgtgtattgcatgattttatatatacatgaacttttatatatatataattatatatattatatataattttatatatataaatttctatatataaatatataaaatcatatatatgatatatattttttcatatacatcatatatatttacaaaaattatatatcatatatcatatgatatatgagatatatatcatgatatatatgatatatgatatatatcatatgagatatatgatatcatgagatatatgatatcatatgatatatatgatatagatatcatatgatatatatataatatatatatgatagatatattatatatgatagatatgatagatatcatattatatatgatagatatgatagatatcatattatatatgatagatatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatagatatgatagatatcatattatatatgatatcatatatataccacatacatcatatatacatcatatatacatcatatatatcatacatatatatgaactttccagaataggtatatcaataaagacaggaagtatacaagtggttgccacagcctgagaggagcagggaatggtgagtgactgctaatggatatggcactttttttggggggtgatgaaaatgttctggtcagacaatggcaattacaaaactgtatacacacgaaaaaccaaagaatcacacactttaaaagggaggatttagctcggcatggtggcatgcgcctgtactcccagttactcgggaggctgaagcaggactgcttagagcccaggacttcaaggctgcagcgagctatgatcgctccactgcactccaacaaggatgacagtgcgagacccgttttctaaataataataataataataataataaataacccaaggtacccagttcacatgcaaaaccactggtaaacataaattatctccaagtaatctagaaagaaaatgagcacataagacgtcttctaaaaacacacatatatttctttacatgttacatttaacgtaaaaatcagctatgcagaagttacatgaacattttatgttggaaaggtaaatgactattattaatacagaatggttaagtacatttatgtttttatgtacaaacgcataaaaggaaaagcatccttaaaataaacaccatcaatggctcctcggtggtcacaaaacaaaatcctcacacctttgtcttccttcacaattgagctttatccaccttttcaggcttatctcccattattacctgacacaaacttgggtgggccagagtttccactgaccatcccccgactattcatccaacactatgttcactgcctcccattcctgaccatttgccttttgtcttcaactaattctggggacgttttgtccaaataaatgatccatattcttgaaggctggaatcaagtcctattacaaatatattttctcaccctctccagagcatagcaacccagcatctactggcctctcacagctctaaccatccacaaccctaagctggcttctcatcaaacgggtacttttcaccacccaaattcaattaattcactcttacaataatgaagaatagtcgcctacagcctaccttttccagccttgattcaatcatttatcaattttatcttcaaagtccctcacttcagggagatgatatatcagctttcacccagagtcctaaagaaaacagcactcttgccaatgacatagtgccacctagtggcaacataaggtaaatcacagtggcagtagaaggatctccacactacttttacaggaatgcactgcaggtaaaaaataagaagctacagtactgtttggcaggacaatttgtttcatacgtgcatactatcgccctgactaaattaactcgcaagtcttacaggtattatttgttttcagttccatgcacagattagccatttagtacttactaaatcaaactcaatttctgaagtgtcttacaccaatatattcatgcacatatggttaaaattttccttgaggatctatcatgtgagagtgtggcttattataacaagtaaacagaacaaataaatacaaaatgaaaagaaatcgtatgatttactcgcatataagggagcttgttgtggattaagtttcatgacccaggacactgaaacagaaatggaataaatgagaataaaattaaaagttgtcatcaaaaatatagaagccatctaaagacctaggtgtcaagcatagctctatgagtacaatcccgtgcctgagattaccatatgcccagctgtatgctatacactaagagatttaggaaggaagcggggtcagggattgaccccagactccatcttttcaagtggggaagaaagatcttccgattgaaaaataaaggcaaaaaaggcttcaccgtcacagaagtttcaacaaccaacaggatatttaaaacagttatcaaagcaaaaccattgtatgttcacttacatttttacatagtccctcaaactcacaaaatgctgtttactcagggacttcttccggtcttactagggagcctggaaagtgacgggaggattgcaagggaccactagaaccctcttcctcaattccccttctctgagaagggaggctacagcttgcctctctaaccactaaaaggcatgaccctcctcaaagttaatagccggattccctgatagatattttcactaaatgaattctcataaaactctcactaagatttagagaaggcttccagggttgaattcctgaacattaagaacagcatgttttttaaaagtttaacttggtgattggaccaggacttcatctaggctatgaatgctcagaatggtaggtcctttaccaaacagcttgagtttgtgtataaagtgatctcatcctcttaagagtcagagaaacagaaccaagcgacttcactataatttgatctgaggaagtttcttactcacaataggtaaatgaaggcacatactaaccagcaatataaacaacaatatcaagtgtcattcacacatgcaaaaaacagacaaaatcccaaactctgtgttctaacaaatcgcaaaaacctcactaacaataaattgaaatgaccaaatgtttggactgaaaagcaatgccttggtagcctagccatgcctaactcaaataacagaaccatctcgatgttaaaatcctcacagatcaagctgtgtatgtctcgggtcaagacttcgccaaaaagcagtgagcacacacttaagagggaaaaaatctacctcagcctcctaaatgcaatcatctctacacgagttgcaggccccaagcttcaacgtgttctgctggacaacgcagtagaaagctgacaagcaggtggccttcccacactgactgaaccacctccatgcccatgtccattcattttcttgcccaccccatgtgctataacagacctcctggctcagggcactctttccttcctgactgccttcacttaatgactttgtacttttaggtgcaaaaattatctgcagaaatccacactgaaaaccaagcttgagaaaggcagcaataaccaacatttttacaagaagaacaaggtcaatatcaagcccatcagattcaaatagcaagcatggatgaaaatgaaagattgaaaggcttgagtgccttcttaatgtattaaatatccatttaatttacaattaagctcactgtgctcactggccttttaatcagctttccaggtcctgctcagacttgcctaggacatgggaatgaaagaacctatacatttatggaccaatctaccttaactaacttgtcaagtgttcctgcatcaagcagaagaaacatcagtgaaactgatacaggaattaaccccttgttaatccataaaacttaaaggagcgggatccaatcttctggcttccctgggccacgctggaagaagaattgtcttgcgccacacataaaatacacgaacactaataatagctgctaagctttaaaaaaattgcaaaaaaggaaaatctcataattttttgtttgttgtgaggtggagcctcactctgtcacccaggccggagtgcagtggcaccatcttggctcactgcaacctctgcctcctgggttcaagccattctcctgcctcagcctcccgagtagctgggatgataggcgtgtgccaccatgcccagctaattttcgtatttttagtagagacggggtttcaccatgttggccaggctggtctcaaactcctgacctcaggtgatccacccacctcggcctcccaaagtgctgggattacaggtgtgagccaccgtgcccggccaatgttttaagaacgtttacgaatttgtattgggccacattcaaagccttcacaggctgcatgcagcctgcaggccgcggttggacaagcttggattagagaaatctacagagacaaactagtgacttagtagccctctgatagctcatgatttgcaagaaacttaggatgactatgtgtaaagaccacaaacatcaatttaactgaatggttcccgccacactggaatgaggaagctgagcaaactcagaggactctaagaaagggctgatgtcatctgaactgttcggaattataaactcctctaaacatgtttcaaagccagaacttgtaggagttgttctgatacacggattaaaagagggatgacaaagtgtctgtcccccacactggtcaaagggacaggtcattgttatgctggcaatgcaggctgctgaaaagaatgtatctgtcaaaagtaatcaaagtaatgaccccagaaggctccagaaacagactggtaaattcaggttgctttcagacttccacaatgctggcacacaaggggaaagacaaaactaacatttacagagcattatatttgatattacatttaatccccattaaaaagatactatttcccgtttcactagtgaaaaagttgatctttcaaaggttaaattatttaacaccaaggtcaaagggtaagttggagagaccagattcaaacccagtctgacattaaaacatgtgttttccccccacatcgtctcctgctaataacctcaaatctaaaaactgacttgccctacaccttgagccccatcctacaaactctccctgacgttattaattcagctgtcactgtgcacctacaacgtgccagacaccatactcctcaacactctgtaggcacagaaggaacagataaaaatccctaccttcatagatattattctaggggtaacacaggtaaataaaacattaaaatagttttcacatagtagcaaattccatatagcaaaataaaacagaagaaggaatagcaaatgagggagatgccctcttaaacatggtgctgagggaaggcctccctgagaaagatatcatttaccccaaaaataaaaaagcaagtaatagaaaaaacaggtaaaaggtgttctagacacttaaacctgccacattgagaactcagggttctgatgcaaaacctcgctgcatagaatgcattaacttatttttatacatttaaacaaacaaactctacttaagaactgtgttctaaaggaaggagcatattacaggaaggcaatttttggtcagagtagacacacttaaaaactaaacctattgaaagaccaagaacaactgaaagtctttgctttgtcagatttttgaccaaaaggaaaattaaagaaacacaccgtgcccatccaatgatttcaccaaggaattttaagagagaaaatcctacttcttcctcacccagtagccagtgaaatgactgagcaaattcacaagttcactggggctgctttcatgtaacacagggacaacacatgacagacacagtggaaccctacaggttgcctagtatttgaaagactgtgaagaggaggagatgtcaaaattcaaagtcttaaatgatgtagttttaagtatgttcagcaatttcaccactcagtagtaaagccagctacagttgaaagcaatcagaaatttgaggggtgtgaaataagcagaagcacagaagttaaggatttgtattcttcccacattttccactttattttatactgctgagaaaaaacaaatttaatagttttctgctgtataagagagacacattcactttatgtcacagtaagagtcactcaattttaatacaactatctcaatgtataaattaacattctcccccctgcccacacatagtaagtctcttatgatgttgctgattagagaagcaaaagttgccgctacaattctcttcctgcattttaatataaacaatcatcagtcttttcttcatagagtgcagtgtgggcactatcatcagaatgtaccagcactgggtgtgcaaagtttacaaagattagcaagagcaaaagtgttgagatttttgaaattcatgctgctgcaaagaagtatgtaaaaactcactcaccatagaggaccacacagaaactcaggcatgaagttatatggctgtgtgagtggtttgggagaaggaacggaaagcacttccaccaacctatatgcctgagcaaattaatgcaaaacctcagaagctacaaaaaagtttatctacctaaattaaaattggtgtccacagcagtagccagcaaaatgcctgcgaagcgcaaagtggtaaatattttagggtctgtaggtcatatggtctctgttaaacaatatgtaaatgaatgggtgtggctgtgttccaataaaacttcatttataaaaagaggcagcatggtacatccagtcagcaagctataatgtaccaacccccggtctaacactaaccaaatacctcttaataagccaaagaaactgtgtcctcttaggccggaagcggtggctcacacctataatcccagcattttgggaggccgaggcggggagatcacctgaggtcaggagtttgagaccatcctggccaacatggtgaaaccctatttctactaaaaatacaaaaattagccaggcgtgctggcgggcgcctgtaatgccaactactggggaggctgaagcacgagaatcgcttgaacccaggaggcagaggttgcagcgagcctagatcacgccattgcactccagcctgggcaacaagagagaaactccgtctcaaaaaaaaaaaaggaaataaaagtatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagatttcaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacacttttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcagtaagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggcgggtggatcacaaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatgtgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaaggggggacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgtgcctgcactatgttaagaccactggcaaagagggtacaaagttaaataaggtctatcacagccctcaaggagttaaaggactagaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaaatgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaaaaaaaagaaggaaaatttgagggtttttgattttttcaacttcacataccggtttgcctttgcaaaaaaaaaaaaattgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgctccggctccgcgacagctctgcacgtagccccagccaccccgcgcaccggctacaagccgcccgggggtggccggggcacgcaagagggcagtaacgtctgc

SEQ ID NO: 1569 - DNA, 8476 bp, Homo sapiens
tgttagcagtggtgagttagggaaggagcagaataaaagatattctacctagcaatggggacccgctgtagtagtaagaaactaagtaccttaagggactggggagttttcttaaacctctctggcaggagcatgtattggcctctgtttcataaatgtgggtcattttcatcaccttgggatgttagactttggcaggtctgatgatgaaacaaggctgcacatgctcgtaagaagaaatgaccttcccatccttaatctccttggtgatggtgcaaattttaaccagtatccgggacaggggtccgcaggcactgcagtgctcctttaagctgcagggggatgaggatgtgcaagctggggccgtgctttctatggctccggacttacaagatgtccaaggggaaggctcacatttggtggcacgtgggtaacagggacgcctaaggaaaaaaaacacaattttagctgtgattgagggaaggcgatgatggtcatggagaaaaatgattgtggctaatttttttaacacgtgttgctcaagacaagtacatacttctaaatgcttattcatttattttgtactgtagttactggaagaaaaagaatcagattaaatccattggaaatcagcatcctaggtttagaagtattcgattatgtaagtttccattagtcaataccatcacattgtggaaagaatactgcactagcagtcaaaagactgaggcagagaccagctctgtcctttaccagctggtgacctcagctaagtcatttaacgcactcaacctttagtttttcatctgcagaatggatataatggaaactaaacccacaggatcaacagtgataaggaacaagttgagggcattattatccgaggaatggaaattaaccagatatttttctcattgaggagttagtcatactaatagtggtggcctgaaccccagctatgaaagagtcctcactgtgtcatcaggaagcttcaaagtgccttctggctgtctatgcatagtttttagagaactgaagtaaaaagcagttcatagtaaacactctttttataaacataatctttctttgatgattcgaggtattttggtatatgatcacagctcctaaaggtgacagcattgatgaccattgtgctcacataatgtggtcatgccaattaaaagaatgctgtgaagagttcactgattattttcgggaagtaggtctcctttgcaattgtaactaagtctctggggttttagtttggactgagttgcttcaaagaactcatcctccatatatgtttacttatgggttggttagcttcttattgcttacaaaaattataacttttattttttaaaaaagatgctaaaacatacatgtgtacatgcttctgttggcctcaaggactagtggctagatagggttaggggtttcagcctgagcagaatgttcctccaaaggagcctgggttgttttgtacaagctcatgaaaatcagacgttcatctcagtggggaaacatctgtaatggtcaccaggaatattcatctatggggaaataattttttctctagtaatttttaaaactctaagaaggtaagcaacctataagaaattaacctggcccatgggctcttcagaacagctcaggtcagccaatgcctcaaatttggataaggttacaattgcaagtcttcctcatggcacagcttgagagggtgtgtggatgcctctgtccaagctccccatcactggcaagaaggtcaaacaaagcacttgacccctgttgccagtggcagtacatatatctgcgttcatttacacttttttgtcatagaagttgctgttattttacatacttgccatccgagctctccagaaggctgcggtatgtggtaatctcacattccagccgggacttgacgtccagcaggatctcgtattcttggttctgtctttccagggcacaccggatctctgccagctgagcttccaggttatcaatcagactctggatctgggtcagcaaggccgtgtagcgagcctctgtctccgttaggatgcactcttgggaatctctctaccatggagaaggatagtaggatttataatgactcctttaagcccaggtcacctgtgacctgtatcatttaaaaaaaatggtttctttgtgacactactgatagatctccaagcactttatttattgtttcctaatcaaataaatccaaaacccaaatgatcaactatgctaaaatctgctttcctttatctcttccctctttctctctttctctttttgcttctctgtaagtatttgtttcactttctctttcttgaccaaccaatagtctcgcaccacactttcctacttaggagagaaaaaataataacttaatgcacacccaggcattaaaaatgcattactggctgggcgcagtggctcacgcctataatcccagcactttgggaggcccaggtgggtggatcacaaggtcaggagttcaagaccagcctggccaagatggtgaaaccccgtctctactaaaaatacaaaaaattagctgggtgttctggtgggcacctgtaatcccagctacttgggaggctaaggcagagaattgcttgaacccgggaggtggaggttgcagtgacccgagatcgtgccactgctgtccagtctgggcgacagagtgagactccatctcaaaaagaaaaaaaaaaaaaagcattaccatggcacttcattcagtgagtgttcgtgtcttaaaaaaggaaggaagcaatgttttaccatatacaatttatccaccagatcaattcctttatatgtaaaatatgaaagttgaaactgatgagtaaatttcattcctgctctatcattctgtaagtctatggataatgatgggattttaggttttaatagcctattatttgcatgattatcccaatttttatagatgagaaaactgaggttcaagtggttcaatatgttgtccaaggtcacatgactagctggtgacaaaaccagtgtggggcaaggtcttcccaaaagccttcacatcagagcatgtaagcaattctctacttcagagaggcattatcatgagacagaatgatactggctttggaatctaaactctggctcagactcttatttcttttgtgactttggatgagtttcttaatgtctcaggatctcagtgtctctataaaataggtgggctgaaacttaccttggatttgcttgggaaaatcactttagctcttggagcctcatctgtaacattcgttaataattatgccaccccccctcttaggattgctttataaatctcatgtgatagcttgtaaaaatgctttgcatataataaaatgctctcccagtgtttcccaaagtgtacttcatgaatcattaataccatgagatgttctaaaaaaagtggggggatccacagtcaaataagttttggaatgctgaataccatatacccccttcctggagattcatggtgtatattagcttattaatggctcacaggaaggcaccctgtttaaccttggtttagtgcagcgtttcgtagacttatttggccacaaagctctttttcagccatagacgctttaacaaatgaggaactattgttctgaaagacacagtttgggaaatactgcagcacacaggtgtaagggactgtttccatctttgctgagctaggcttggtcagcttgctcagtaccattcgatgctgggcctgcagttcaacctccagagtgttcacactgcgtctcagttctatgatctccttttggcagcattgctgctgttgagagctggtcaccacttgttgattcagctcctctatctgaaacacacagccagagactgagaatattatgggaggaaaacatgactttgattaaagggccctagaaatgcagcatcagcttattgtttttgacttttctatatcccccacctgcgtgttgaaccactgttccacatctttgcggtttgtctccatgatgggctcatattgacatctcatttcttgtagaacctggtttaggtcagcagaaggggcagcagtcacttcaatgtcaagtctctccccaagctgacactgtaaagaattgatttcctaaggaaagaaaaagactgtgaagtcacttggtgaacagataacccctttgtgttcttgtttcactctaactgctacgatttagcttaattgtgtctaaaatatagcccacaacaaaggaatacatgatttacaggtgttattgagatgctataaaatgatttaagactctttcaggtaggactgtgtgtttaaatgtgtgcaaaattaaaaaaaaatgagtagcaagaccagagttccaaaaaatttagatcatttccagggctggataatgggtgaaacaggataaaggtggaattgatcatgagagattatagtctctatggtgcaaatacgggattgtgccaatattgacttgcaccaatattgacttgtaccaatgggaggtggcagaagcctgtatagggatgcctacaaacatgggaagactgtaaggacagaaaaattgggttccttcttgtagaaaagctggaggggatgttggaggcctttcttccccttatggctccagatattgtgttggagccagtggatttgaaatactaccttgaaccagtgctagtagcagtaggtattttcagggctaaaccagagtagtacgtagcagtggtttggctctgtgtccccacccaaatctcatctcgaattgtaattcccataattcccatgtgtcaagggagggacctagtgggaggagattggatcatgggggtggtgtcccccatgctgttcttaggatagtgagtgagttctcacaagatctgatagttttataaagggctcttccccctttggtctctctctgtctcctgctgccaagtgagatgtgcctgcttccccttaagccatgattgtaagtttcctgaggcctccccagccatgtggaactgtgactcagttacacttctgtcctttataaattacctactctcagttatttctttatagcagtgtgagaacgaactaatacaagcgggcacaccctttgtcaggtgcaactcaaaggaactgatgctacttttagggacttagcttgtgattactctattggtctttgtctcacctctttgtggttgttcttgaggcaaaggagctcctctttcagagactggacttgtgcctctaggtcggccttgcccagggtcagcacattcaggatctgcttgaggccattggcatctgactctaccagctggcgtagagacacctcagcttcgtatctttaaaaaccagatgggaaaagagagacatctgaaaggagatgatgcaaaccaagccaagcagaactctcatctgcattttgctctgggcacctcacttagtgtatttctattagaagttttattctctttggaggtgaaaccatttgatatagatcataacttaattattattcccaaattagtttgctagggggatctacattgctgttctttgagatatgggaatttattgtccttcctctgcccctagtggcaatgcaatgtaagtgaagaaagcactggattagggctcagaaaacatgtgtccaagtttcggttttgacttgtgctagttatgcttacctttgggtgagtaacttagcctcactaagccacagatttctcaccttaaagagagtaacaatatattagtcctatctattttactgaactattgtgtaggtaatcaaatgggttcacaagttagaaactataggtactgtatacatgtgagcagttattaatcttaatcattcattgaatttgaaagtcttttctgggcttgtgccaacatcatctggggcaagagggttagtagacatggggacaattttgttgagggcatctcggtcagactcagggtgagctctgtcattgatgacggtgttgggtgggcttacttggctctcaagtcatctgcagtcagtttggtgttgtcaatttgcgagaccagtctggaattctcggccttggtacacaagatctagaattaagagattgtacacacaaatgaagcaaacaccaagatttccttctttaagaaccaaggggtttgtgtgtgtgtcaagtaacaggggaaggctaagtagactttttattaatcttcatagctatgctcacaaagcttggaaaacttcagaaagtcagatttcctgttattttcctaaaagatcagcaaaaagtacttaactagaaacttttaagtattttttttgttgttgttgttaaaaaatccaggctgagagcagtggctcacccatgtaatatcagcacttgggaggctgaggcgggcggatcacgaggtcaagagatcaagaccatcctggccaacatggtgaaaccctgtctctactaaaaaatacaaaaattggccgggcgcagtggctcacgcctgtaatcccagcactttgggaggccgaggcgggtagatcacgaggtcaggagatcaagaccatcctggctaacacggtgaaaccccgtctctactaaaaatataaaaaaaaaaaaaattagctgggcgtggtggcgggcgcctgtagtcccagctacttgggaggctgaggcaggagaatggcatgaacccaggaagcggagctagcagtgagccgagatcgcgccactgcactgcagcctgggagacagagcgagactccgtctcaaaaaaaaaaaaaaatacaaaaattatctgggtgtggtggtgcgtgcctgtagacccagctactagagaggcagaggagggagaatcgcttgaacctgggagctggaggttgcagtgagcagagatcgcgccattgcactccagcctggtgacagagtgagactccatctcaataaatacataaataaataaataaaaaataaaataaaatccatcctaaatttatataaataccatgatccactagaatgtcaactccatgagggcagggactttttaaaggtcaccaatattttcccagaatctagaacaatgtttggcccaatgttgttgctgctcagtaaacatttgttgaatgaataaaactgaataaatccagatatgtagtagcagaatacgtctgtgcataacaaacttaggtttggtgtagaaacaaaccaagcaatgtggagatgataacataagcataaaaggagaaaaaggtggtgatggttgaaaaatggataaaaactaaattgcttagaaactcattaaagcaaaatttattttctctgatctctgtttccctatttttatttaaaaaatggcaacaacttgctgttaacatcttttggtcctgagtcatctagttataatggtagagtgtatttctggagaaaggaaacaccatgagactcttctttttgtttctgatttttaaagacatagtctcacttttgtctgggctggagtgcagtggcaggatcttggctcatggcagcctcaacctcttgggctcaagtgatcctcccacctcagcctcccaagtagctgggaccacaggcatgtgccaccacgcccatctaatttttttttgtgtgtgtatgtgtgtgtgtgtgtgtgtgtgtgtaaggatggaatttcatcatgttgcccaggatggtctagaactcctgggctcaagtgatctgtctgcctcagcctcccaaagtgttaggattacaggtgtgcatcactgcgcctgaccagaaatactatcagactctgaatgctgcctcaagatgacaatttcactcaagaaatttttctattcttcaaaaaaattttcagcatcaactgaacaaaaaatattaaagtttagcaaataactgttgcttggaaaccattaattcacaacacgattaaacaggttcttaggaatcttaccttctgctggagctcctcaatggtagtgtagtaagacaggtaatcaggacatagaacagggagctctttgttactttcttcctggattttagattccagttcagcattctctcgttctagcattcgcaccttttgcaggtagttagcaaggcgctcgttcaagatttgcatggtctccttctcattactgttgatgccttcaccataccagctgcagtcatccagagaaaaacgggcattgaagttgttcattaggtagatgggcttgcgacaaaagcgaggagtgggttggcagccctggtcccagggaattctgagaacgtggccagctggttgacagttgttgactgtaaggccaccaggatggcagccgttgttagaagagatggtactaacatttgtaatcctagagcagttttgacatggggttgaaggagaattggttgttgtacagcccttggtgtccatagtatgtgtctggctttagtttgttccaggtctgtg

SEQ ID NO: 1570 - DNA, 9420 bp, Homo sapiens
acattttatcatattttattcctaatatttttcctcagaaagatacacacaactattttctaagatatatgacatttctcatgggttcattaatttatttgtatttgaggagttaaaaaatattttcagcctgggtttatgtacattgaaactatggttatgggtttagatgatttccttgccataaaatgaatattctatcaacagtaatcagccatagagctatatttaccacgctaaaggaataaaacacgttttatttggagatgagcaagaatgctttatgggcttccagtataccacaaataagccggaaggagaggaaatagtaaagcagaaagactgaggatacctggagggcaattccaggatatgagagcctcctggatttgtgcttccggtttggatgtccctggttgaagccccatctcctttctaggatgctgctggctttgattcctctacctgctgtccttaacattcacaagcagcagttttcaacagtgcagatgacataggctgagcatggctcacaagtgttgctcgaggtgcatgtggtcgaacatgggctacaggaaagcctggggaaaaatcgattttcaaccaagattaacaagggaatgttgataaaatggcaactcagaaaaaccgtgtcaaaatttgccctacaaattatgttctgaaaaaaactctgcacaatagcattgactgaagcctgtttcttctctgcacccagaattgccacttcatgttcactgtagcagtggcagttgaatagtattttatattttttcttgattttgcaaatgttatcttaggcctattcctgattttcctttagtggaaaacaggaacaaagggagatgccagcatgaaatgttacactaataattaatctgcctttagaatattttaaaaatatctctagtgtcatgttcttaacctcagccacttttcagcacttttttaagaagatccctaaacacactggggaggtctgaacttgtccagactttggggaaacaggattcttttacatcagcctctttgtgactctgggggatttcatgagtaactgtggaacttgcctgctgtcctcgctgtccagcaggccccagtacgtgttgatctcaccctccagccgggccttcacgtccaggagcacctggtactcctggttctgtcgctccaggtcgcagcggatctcggccagctggttctccaggttatcgatcagacactgaatttgggccagctgggagctgtactgggcctcggtttctgccacggtgcattccagagattctgtctgcgggaggaaacattgtccaaaggaccatgaagtgcagtctctcgggccagagtgcctactttcaaattcctgcttacccttttctagctatgtgaccactggcaaattatttagcttctgtgagtctcagttttattctctgtatagtggagaatacaaagtatctgtttcattagacggttgtgaagattaagagttaatatgcgggctgggcgcggtggctcaggcctgtaatcccagcactttgggaggccgaggcgggcggatcacaaggtcagaagatcgagaccatcctggctaacacggtgaaaccccgtctctactaaaaatataaaaaattagctgggtacggtggtggacgcctgtagtcccagctactcaggagaatggtgtgaacccgggaggcaaagcttgcagtaagtcaagatcatgccattgcactccagcctgggcgacagagggagactccgtccaaaaaaaaaaaaaaagagttaatgtgcgtaaagcatttagaacagtgccagccatactgccactgttctacgtgtcaactatcactaccaccactatgactacagcaatacatgacatatttgtgaagcttaaggactatccacaacatatgagaggaaagattgagtttgggctcttggcagggaggggtagtatagtgctattaagagaagaggctctggataccagaggctgggactggcatatgtgtggtaaggggatgaagagaggttggttaatgggtgcaaacatacagttagacagaaagaatatgttttcatgttggacagcagagaagtgtgactacagttaacaacaatacactgtgcatttcaaaatagctagatgggaggacttgaaatgctcccaacacatagaaatgataaatacttgaggtgatggatgctctaaatatcctgacttgatcattacacattctatgcatgtaacaaaatatcacatctacgtaaaaaaaatttacgcatattatatatcaataaaaataaatttaaaaagagagagagaagagactctgggattcaactggctgaactcagcttccaagtttgcctcttagaattgcatcctttgcaagttacttaatctgagtctcagttttccttatctgtgtcatgggataaaggtatctatccggtaaagttactgtgagccttaaatcagcatagtgcctctcacaggatgaatgctcagctattgttcttctaggtgttctccgcagggcctaatgacatgcacacagtggtgcttgaccagaactggttcatgtcatcttgaacgcatggtgttcctgttgcttgagtggggggtggtgcagtgaaggataaggttgaagtgtagatcctgggaaactgtaggatgaaatgtttgaaaatgattctttgttttagatataacagtgagcctggaaaactggcctgaatcaaatgagaattaaaacctgccagaatgcttaagcgaccatggcccggaggtttctctccagctctgcttctccctccctgtctctggaggctgctgcagcatcagactcaagcccaggagtgaaggtaaggcatcttagaggacaagctgtggacctgtcacttctgcttctattaatagctgggtaaacggcagtactcgggaaaggcaaggaaatgtgatcctcggatatggaagagggcttaacatctcagggcctgacttatcagtgacacaacggacactgcctttgcctcacgcaccaggctttgctgtgcttggagctcaatttccagagcactggctgtgcgtttcagttccaagatctccatctggcagccctgcagctgctccgcgctggacagttgctgctgattcagctcttctgtctgaaacacagacaccattagagaattcaaaaaaggcagaagtctgtaagcctgacattttttcaatctgggtactgacctgaacagccaaccattcttcagcttctctgcgattgttggcaagcaccgtttcacactgacagcgcatctcatccaggaccctgttgaggtcaagggtgggggcagtgtccagctccacactgaggcggtcgccaagctgttcacgaagcaagttgacttcctgaaagtgggatggtgtaaagaatgtcacagaatggtggggaaaaatccatttgacatccaatggcattctacttctgttttttggagcagtgggtaaaagtgtgagattttgattcagattgcctgggctgaatctcttttcaccacttagaagggcctcagtttcttcgtctgtaaaatggacataataattggacatttttccagaaagttattgtgagatctagaagagtcaatctacacataattaacttataaaagttaattatgacacatagtaaggtgtcaataaatgttagctatgattgtcatcaacaaacgttcaaagagcaaatgtactttgttacatcattcagcttttcattttctagctttatcaatatatcagtggctgtatattttatgatttttagaagtttataaatgcggaatatttaaaaacactggtccagatagtgcacagtctttatcccttttttgaaatggacttcacagtctgttcctcagcctgattttcataccctgtggactggagctaggggtggcataaagcctccaaaggaagccatttgtgaagttacctcctccacaaaggcaagggcaggagaagagtttgattccttcctctggcgctgtctaggggttatttcacaccttaaatcagagacacactggaatgatcaggttgaatagtaataatgcctcgagtagtttttgtttgtttgtttgtttgtttgttttttgagatggagtctcgccctgtcacccaggctggagtgcagtggtaagatctcggctcactgcaacctccgcctcctgagttcaagtgattctcctgcctcagcctcccgagtagctaggactacaggcgcctgccaccatgcccagctaatttttgtatttttagtagagatgaggtttcatcatattggtcaggctggtctcgaactcctgaccttgtgatcctcctgcctcagcctcccaaagtgcttggattacaggtgtgagccaccatgcctggccctgcctcaagtagttttattccagcttaaacaacatctgcccaaattcgatttacaaacatcaacagatcatctgtcaatgtaagtacgttactctcggagtccttcagcggagttgccactttccttacctcttcatggtttttcttaaggcaaaggagatcttccttcagagactccacatgggcctccagatcagatttgcacagggtcagttcctccaggatcccatgcaggctgctgatgtcagcctctaacagctggcgaagggacagttcactctcgtacctttcacagcaaaagagaaatccaacgcttactttgctgaacgctgtgcaaagtgtggggatacatggaggatcgacacacggacttcaggaagccatgtgcataatttctcttaattcctaagtaatgataaattcaagcttttaaaacattcttaactttaaaatattatatagagaatatttgtgtgtgtgtgtgtgtgtgagagagagagattgagagagagagagccataagttattttcaaattaaaattaaagccgggcgtggtggctcatgcctgtaatcccagcactttgggaggccaaggcgggcagatcacctgaggtcaggagttcgagaccaacctggcccacatggtgaaaccctgtctctactaaaaatacaaaaattagctaggtgtggcggtgcacgcctgcctgtaatcccggctactcaggaggctgaggcaggagaaccacttgaacccaggaggcagaggttgcagtgagctgagatagcaccattgagctctagcctgggtgacaagagtgaaactccatctcaaaataaataaataaaataaaattaaattaaacttactttgacttaaagtcatcagtggccagtttgcagttgtcaagctgtacagcaagtctagaattctctgctttcgtgcataagatctgggaagcaagtcattatgtgataaatgattctttgagagaaacctaagtaaacttctatccaacagctatgccattagctatcttttgaaagtctttataagaaagtataaaatcaccctcagcctgcttttttttattaaccttgtcacttcatgaagaaaaaaagcagagccaatttagaaacaaaataatgaaataaaaaggtttagttttttaataacataagacattttgcaacattctcaggcagttgaacaccattaatgttttctccatcagtagtttgtattatgagtatatcctctcccataataatagaaattcatggagagaagaaaatgattactaggtagttaaaaagatggcatttcatgatctgtgttcagataatgtaaatgttcagtgtcacgtacaaaagcgattttggatataatacagtttttctgcattctatagatgatgaaggaaaagtctacaggcaagttactttattatagtcactcagtaatcaggggtagctctggggctgatgctgaggttttctgactttcagtccggtgctctcccctatgtatcactaactcttagaattttcctttcccttggtttccttctgtaaaacagccccttctagtagaaagataaagcaaaccatagatcaggaaggtggagcactagggcaacaggacacagaccttttgttggagatcttcaatggtgttgaagtaacgctgataatccgggcacaccattgggatatcctgttcacattgttcttggatcctggattccagctctgcgttggtctcctccaggctgcgcaccttctccagatagctggcgagtctgtcattcaggaactgcatcgtctccttctcattgctagtgaacaccccatcctcacaccaggcacagttccccaccaagcagggactattacaactcccagtaaagtagcatggcaggaggcaaccagtcagcccgcgagacctggataggaagcttggagtctgacatcgggatgtagcacaggtaccggggagacaagctgtttccacggagcagcttgaggcaggtgcacaaccggaagccgtgccacaggactcaggagagcagtgtgtggaggagcagtcagaagtcatccttccagaagcaaagacagagactggctgcaaaacttcagttgccttgactccaaaactctcctctcctgagagttttataaccccccaaaatgggtgtttacagactgcaccggatgttttctttatcactgatggtgccagttttcgtacaaacatctcattagagttgtttatttactgaggaagagttttatgcctcataaaatagggataactttaggttaccaaagcaggacccacaccatttccatgtgcaagacaaaacacttatttcagaaaatcgtcataggaagcattgtgcttttgacagaataataaaagaaagagaaaatttggccaatgaataattatagatacaactcattacaaatcaggaaaataatatgtccacagattttgattctgtggattgattgcttgtgtccccttttaaaattagtattacagctcacaaaatgacaattatttgtttgtgccaccaccataaaaatggtcagtgtgattagtaatctttcaatgctttttgtgatctcagagcatgtgctgataaagactggaggagtgagctatatattgggtttaaagtgtgtgtgtgtgtgcaaaccatgtctacctgcgtacaaatggaaaagtcactttacataactgataggaataacttgtttttctgcaggctaaaatataaattggttagagctggaattatgatctttgatttcctgaaacttgccttctccacatttctcattgcttattgttagataagttatactattttacctgtattcctaataagagtgaaatataaattctaagttataaccttttagtcccttgggaattccttaatgattatacttcagagtaggggcaaggaacccacaggaatcttttcttctgagatgtagagcctgttttctcctatttatttatttatgaaggcctgaatttcatgaaaattgaaaatactggaacttggaaaataaaattctatttaggttccaaatcagtaattccactggatgaaatctctggtgccaaatctgacagacaggaacttgagatacgtaatttttttgaattatctcttggatttcacctccattgtgaaggataatctatttcactttgcttggttttagtcgttacatttatttcattttcaaaggtgcatagagaaaattgtctctagaatttttaagaacattataggaaaaaaacagattaatctgaaaaagttaaaaaatttttgatccagaataaacttattttttctcctaatcttgagtgctacttcctaggtacctgatagtagaaaccaaaccaaaccaaaccagaagaacatatgtaagtgagttaaaatagtctcttaggatttattactccctgggcagagctgggtttgaatttagtgattctctttacacatcaacacttatgcaaaaagttcttagagtgtctcatggtatattgacgctgctctgcaacaaatatgagttcaaggattcaaaaacacttctgaaaaattacaaatctctgaaagaaaattatcttttcacagtaacctaatgagtcaaaagaaaaatatctgtgaagaaaacccatgttttggttgtccatcacaggctccagttagctaaaatgcagtcatgtaagtgcaggtaaaataagaaatatttccttctgtctggaactaatttctaattgtaaattatttgttactggttattgtcctgcaggtaggactatttattttggtcttgattaattaggtagtgttgtataatgatctatagctatagtctccatcgtagaatatagaaatcacccagaattcatttctgtggagtcctccttagggaaaagaagtcaggctggcaggaccagaggaaagcaagttagtgggtgcagcgcaccagtatggcacatgtatacatatataactaacctgcacaatgtgataaataaataaaaaaaaccaaaaaacaaaaaacaaagaaagaaagcaggtaatgtataagactcaccttcttcatggtccaggacacatagccctcctgcacaatattcctgcacccagctatcaccagaccttcagctgatagaaaaatgtaacttagctcactgcaaccttagtgttatcagtaccacacaaaccctcttcagcacacagtacaagcaccatcctgtaaaatctccagcacgcctttgtctccttgcagacagccccttctctgctgtgctgcccattgcttccttgcaacgtattttcatacgttctctaatatatctgcctttctttacctacaactatcttgataaattcttcttacccccatgccaccagccccagatagttgctaatcacccgtgacaatttctatagcatatcatcaccagaagaaaggaacattgggaatagagaaaaagaaatagacatcatgaaaggccatgataaaaaaaaaaaccgacaacaacacggtagtttattttgcataatactatgctcttaccttacaacatccacctaggctgccagaatcattttcctaaaatacaaacctgctttttgtcgccttccacttatggaatgcaaactttctaccttggcaaatatgaccttccctaacctggtgccaatttacctttctgggctcacttcctgatgttctgtctcacaaaccctaagctccagccatccttcaagcttcgtaggtactattttcttggtcaaatgctcttctgctattcgtttcctggatgaactcacatgtcaagactcagctgaaacgtcgttcaactgcctcatgtggagatgtggctcctcccagagcactttgcacgcatctctgctatagc

SEQ ID NO: 1571 - DNA, 903 bp, Homo sapiens
cattgaagagatgaaaacttttattaaatttaagtcccaataactgttgaaatatttcaggtgatatttatagtaaaatagtatctaactcttttcacattgtaggactttggctgacaaccaggtctaggaaaaatttttggtcttccattgtaaatgaatttacttcctagggaatttatgtggctgtgtgatgagaggttgcaagcccagttataggtactggagttcagaagattgttaggattctaatttggctagttttaaggtgccatcttatcaggatccccagcagaaggaggttttcaacaagtgggctcagagcagtagcagcagcagactgggcggcaacaggactgtccacagtaggatgggcggcagcaggaggcctcggcgtggtgcagctggcagcaggatgggggtgtgcagctcaccacgcagcaggggggcaggcaggtaccctccacacggcagtctgggcggcaccacctgatacgggtgctcacagctccactgctgccctcctggccatagccaatgccaccaccaatgccacagccagttccgcaggagctggtctggtagcagcttggctggcagcagctagtttcacagcagcttggctggcagcagctagagtcacaagtcccaccggttgagaagctaggaaatccacagaagctggtctggcagcagcttggctggcagcagctggtctcacagcagcgtggctggcaggagctggtctcacagcagcttggctggcagcagctggagccgcaggtcccactggtggagcagctgggaaatccacagaagctggtctgacagcaggccatggtgtcaggagttgatctgaaggttgggttgcttggaggagtttctgaattatggctgcctatt

SEQ ID NO: 1572 - DNA, 971 bp, Homo sapiens
ttgttgcaccaatagttaaaatttattagaccttggtatattattcctctttcatagggggtgcaatttgcaggacggtgggatacaggaagtgagtgtcctgagaaggacagatggctcttccatggtctcgtcggcgctgagactcagagcgtgggcttcaatgcttgcaaaggctcagtttcaaggtaaatcggctttttcatttcttgggtcaaatttgtattttggcgtcctcagagagaagagtaaggtctttctggaattgaaaggaatcagataattctgaggccaaaatatttggtaacccccataagaaagacaaagaaaggttgaagaatttgttcgttgtccataagtgcttgaagaaataattcgttcatgaatggaactgaaagtggaaatttcaagttgaaaatcagcaaactggcttttagcaggtgggctcacaggagtagcagcagcagactgggcggcagcaggactgtccacagtaggatgggcggcagcaggaggcctcggcgtggtgcagctggcagcaggttgggggtgtgcagctcaccacacagcaggggggcaggcaggtaccctccacacggcagtctgggcggcaccacctgatacgggtgctcacagctccactgctgccctcctggccatagccaatgccaccaccaatgccacagccagttccgcaggagctggtctggcagcagcttggctggcagcagctggtctcacagcagcttggctggcagcaactggagctgcaggtcccactagttgagaagctaggaaatccgcagaagctggtctggcagcagcttggctggcagcagctggtctcacagcagcttggctggcagcagctggagccgcatgtcccactggtggagcagctgggatatccacagaagctggtctggcagcaggtcatggtgttgggagctggtatgaagtctgggttgctt

SEQ ID NO: 1573 - DNA, 1176 bp, Homo sapiens
ttctttgcctagtatataatatttattaagaaatgacagaagacattgtatcacagatataactgaaatatccagcaggcaagatcattatgatccaaaaaccaagggatggatcagatgttaaaatgtggaaagtccagcctacttcttagaagctgaatgttgggtgatgagcttccattctctctggtgacttgaggaatgtcacttggctataatttggtgtctttgatgttgcaaaaaattttaggtaaacaagataaaatagattataaagcatggaaacattagacttgtggatagttctcatggataaattccacaacatgtcagtaatttttaatcctgcagaaatatcagaaatagtatatcccaagcaaattgatgatcagcaggtggctttgtagcatttctgtgtccccagtgaagggtcaaggtattcattgtagaatggaatcagatagaattgtgagctcatatacttagtagtctccatcacaagcaatgcaaagtctgagaacttgttagtggtccagaggtggtcaagggatgaacagttcagagacactgtgacctaggcaattgaaaataagcaaactggctttcagcaagtgggctcacagcagcagactgggcggcagcaggactgtccacagtaggacgggcggcagcaggaggcctgggcatggtgcagttggcagcaggatgggggcgtgcagctcaccacacagcaggggggtaggtaggtgccctccacacgactgtctgggcggcaccacctgatacgggtgctcacagctccactgctgccctcctggccatagctgatgccaccaccaatgccacagccagttccgcaggagctgatctggcagcagcttggctggcagcagctggtctcacagcagcttggctggcagcagctggtctcacagcagcttggctggcagcaactggagctgcaggtcccactggttgagaagctgggaaatccgcagaagctagtctggcagctgcgtggctggcagcagctggtctcacagcagcttggctggcagcagctggagccacaggtcccactgatggagaagctgggatatccacagaagctggtctggcagcaggtcatggtgtcagaagttgggttaagagttaggttgcttggaggagtttctg

SEQ ID NO: 1574 - DNA, 773 bp, Homo sapiens
ttgcaaggccaaagaacagatatttattagaaaataaacatgccacgaaatcttaagaagaaggaaattgcttcttttacagacttcagaatggcccaggtcttaatagatgagcccagtgctcggttccctgcttggttgatgtggggttttgtgggctcagggcaggaggtttgttaaagtagagaaatgggagtgtgactttttcagaaggtgagttacgcgttccgggcagtcagtgcactgctcagcaggaggaggtcctgcaggtggtgctgcaaggggtcggctggccgcagggggactgcacagacacaggctggcagcaggtggtggctcagcaggaggaggtcctgcaggtggtgctgcaaggggtcggctggccgcaggggggccggcagcagggggactgcacagacacaggctggcagcaggtggtggcccagcagcagggcctgcacaccacagccgtgcacgacgaggggcagcaggtgatggggcggcagcagccttcctgcagggagcaggggtcgcagcacaccgggcggcggcagggctcgcagatggggcgcgtgcagcggggcacgcaggtcacggggcggcacacggtggtctggcaggtcacggggcggcagcagcaggggtcgcggcagcagcagggctggcagcagcctcccccgtagctcagggaggagaaggtggagccgcagcaggagccggtcatggtggtgtctgaggctggtgtgggttgggctgtggagaggagctggatg

SEQ ID NO: 1575 - DNA, 818 bp, Homo sapiens
atgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagcccgttatcacgaagggcccctcagaagatggccaggtccatcccgctgcccctcagggcttcaccgcagagcaatacacgtttccttgagaagcccatttctcatctcttcatactagctcacactatgcattgaagacaccttttcagaccaaccacagatgagaaatacttttcctaggactccagtctaactcctatatcatgttgtctgctttctaataaactcaatactcctaccatagaa

SEQ ID NO: 1576 - DNA, 764 bp, Homo sapiens
tgccaggaaaaattagtttattgacaacagtgagcaacacattgcaaaagatgatggtgacagtttgagcagtaaaaaccatcaggttgtagaatgtgtttgcaaagtccaccccaggaattcttaaaggtcgatttactatccataatgactaaggctgatgtagacacctgaaaatgtgggtgagggtggtaatggacgtctgcttacaccaggctgtatccagatggtaaaaatcactattgtcaccttgtgaaaaaaaatctatttttcttttaactttttaaaaacaccagatagatgtttaggcttcagtgtattgctctgtgggggcattggggtctcagcaggaggaggtcctgcaggtggtgctgcaaggggtcggctggccgcaggggggccggcagcagggggactgcacagacacaggctggcagcaggtggtggcccagcagcagggcctgcacaccacagccgtgcacgacgaggggcagcaggtgatggggcggcagcagccttcctgcagggagcaggggtcgcagcacaccgggcggcggcagggctcgcagatggggcgcgtgcagcggggcacgcaggtcacggggcggcacacggtggtctggcaggtcacggggcggcagcagcaggggtcgcggcagcagcagggctggcagcagcctcccccgtagctcagggaggacaaggtggagccgcagcaggagccggtcatggtggtgtctgaggctggtgtgggttgggctatt

SEQ ID NO: 1577 - DNA, 593 bp, Homo sapiens
ttgctaagccagaataaagtttattaacaaatggtcaaaatggttatttctcaaagagtgatgaaatagcctaaaagacagaagggaggtctccaatggtacccaaatgtgcaaataattaagaagattcatcaagacttggccccggggattgggatggccttagccttgatgtaggcagtagtgagtgctgaagcccagatggtgcagaggacattgggcagccacctcacggaacctgtgcagactcggctggttaacagcggggctcacagggactctcacagccaggctgaacataggtggtcaggttgatcccactcagtccgggagtcgggtgacagttgttgagcagccagcaagttggcacataggtatcaggcttgcagcagggtggggggcaggtgtcacagcagatgggctgaaggaggctgatctcatgtgggcaggtgctgggtaggcagactccacagcggcagcttttatcaaatgagcagaaggtggtggcagggccggtggggacgctgcaggagcggagagcacagcaatacatggcaatgggaggtgggtttttgttgagttgagagaagtct

SEQ ID NO: 1578 - DNA, 694 bp, Homo sapiens
ttgccagagaaatatagtttattggaaaacccaccaagaaattttcttctatgaaaatacccagtacaagaaacaagagccaggaagcaatatgatcaagaacatgtaatctgaggtcttaaagattgaaacagtattttgctaataaaactcattcacctgcccacaggaaccaaatggtttttcagctaaataaccataaaaaatacttttctttttttcccccattaaaaccaaaggtaagttcttcatatctgggtcatctggtctaccttaacatctggcaaactactgaggcaagtgaatactgaagggacagcttctggattcttcgttgtcgggcactgagcaaagtagccatccatcagcagcctcttgggaggcagggctcacagcagggctgagtgaaggtggtgaggttgagggtctccaggcccggagttggctggcaggagttgagcaggaagcaggtgggcacgcagggctgaggaatgtggcagggtgggggacagttgtcacagcagatgggctccagtaaccaaactgtgtgtgggcaggtgctgggcaggcagactccacagcggcaggatttgtcggaggagcagatggtggtggcaggcccagtggggacactgcagctgcgagaggcacagcaatccatggcaatgggcgtctggttagctttcagtttctt

SEQ ID NO: 1579 - DNA, 704 bp, Homo sapiens
ttgtgctatgccagagatgtaaaatttattaggataatcatgaagaacttccttaattttcagaaagataccacccaagactgaaaacagaattcccaaaccacccacagaaagagacactttaatatgaaggaatcgaacagcttcaggaagctataggcatccactgattcaaactgcagttggttatagctgaatggtcattgaaagtttcttggtctctttttttttgcagggggtgattgtggtagtaccatccttgttccaatttctaaagcagagtacattagttgtaggtactgagataggtgaatgctaaagcttctatgttgactttttcaatctcaggcactgagcaaagtagccatccattagcagcctcttgggaggcagggctcacagcagggctgagtgaaggtggtgaggttgagggtctccaggcctggagttggctggcaggagttgagcaggaagcaggtgggcacgcagggctgaggaatgtggcagggtgggggacagttgtcacagcaggtgggctccagtaaccaaactgtgtgtgggcaggtgctgggcaggcagactccacagcggcaggatttgtcagaggagcagatggtggtggcaggcccggtggggacactgcagcctcgagaggcacagcaatccatggctattagagtctgtggtatttatgggtttgattg

SEQ ID NO: 1580 - DNA, 1173 bp, Homo sapiens
ttctaaatgaaaagtttaatacaatatattttgtgaacacaataaagataaagaaccaataaaatagaaaaattctggcaaacttgaacaaacagagacaaagagagaacagggagaaagcaggagagcatgggaggggcagcctcctacctttccaagagaaaagaatgactgaaaggctgacagacaaataatatgtttgaaatggagataatgtgtacctcactgggaaggatattctgtaggctcaaaacgatttaaaaaatgaggaatttagaggattggaataatttcttagctagtggattacaaattatttcatatttggtgccatgactggaagagaaagaaagcaagggagggagtttaaaatgaaccagaatgttctcacagagtcagtgggatggtgatgggctcattggaaacatgaagtccaccctgctgaatgacatcaatcccactccatgtgtcctaatagtcagcacagaagaatggtctacaactgtgggcctgcagtgaagggagagatgagccagggcagtgggctcagcagcaagaggaggcacagcacaaggggcgggggcagctggagatgacacaggttgggcgatagcaagtggtgtggcaggagactcggccacagactggacgcaggcagcagcaggggcggcagcagctggattcacagcaagaggggcggcagcagctggagatgctgcagctggggtggcagcaggtgggctggcagcacacagactggcagcactggggtctgcagcagctggacacacagcagctggggcgacagcagctggagatgcagcatctggggcggcagcaagtgggctggcagcacatagactggcagcactggggcttgcagcagctggacacacagcagctggggcgacagcagctggagatgcagcatctggggcggcagcaggtgggctggcagcacacagactggcagcactggggcctgcagcagctggacacacagcagctggggcgacagtaggtggtcctgcagcaggtggtctcacagcagctggggcggcagcaggtctcctggcagaggtctcggccacagccttggtgagagcacacggagccacaacaggagtttaccatggtgtcagagggtgaaggatctagttgggtttctaggag

SEQ ID NO: 1581 - DNA, 1075 bp, Homo sapiens
ttcagtgccaatagaatagaggtttattttggtacatggaaataacaaggtacaaaaatgtttgcaaaagactttaagagagagacttcactggacttcaaggttggaggctttaagatctgtggccctacaaatgatggaggcaatcttcaaattccttaggcatgatgaataaatgtcctgaagtcaaagaggtgggaggatgttggaggacaatttgtcaatttattaggagattgtcaatgaattcctttggaaggaagggagtttggacaaaaggtagaatgcaaatacagaatttctaaggatgaggtttgcttatgggacccagatcaattctcttgaacagtccgcatgtttgcaatgagagccttcatctgtaggaaaggacgtaataaggaagtggtgtgttcacagcagagatttagcagcaagaggaggcacagcacaaggggcgggggcaggtggagatgacacaggttgggcgatagcaagtggtgtggcaggagactcggccacagactggacgcaggcagcagcaggggcggcagcagctggattcacagcaagaggggcagcagctgctggagatgcagcagctggggcggcagcaggtgggctggcagcacacagactggcagcactggggtctgcagcagctggacacacagcagctggggcggcagcaagtggtcctgcagcaggtggtctgacagcagctggggcggcagcaggtgggctggcagcacacagactggcagcactggggtctgcagcagctggacacacagcagctggggcggcagcaggtggtcctacagcaggtggtctgacagcagctggggcggcagcaggtgggctgacagcacacagactggcagcactggggcctgcagcagctggacacacagcagctggggcggcagcaggtggtcctgcagcaggtggtctggcagcagctggggcggcagcagttctccaggccacagccctggtcagagcacacagagccacaacaggagttgaccatggtgtcagagggtggaggttctcggtgggtttccaggagagtgag

SEQ ID NO: 1582 - DNA, 852 bp, Homo sapiens
ttgcttccccagaaatataattttatttttttttacagtgcaaaaatacagcatacaaatagtattatcctggaagaaaaaaatctcatctgagaaccttgaaacagtagaaaaaagggtgatgagtcagtgggacagagttctattcaagaggagctttgatttttatttactcgttttttttttcaagccaggaattcgaatgatgaaagctggaatttttctcaagattgtcagagagggccaggattagctgcataattatgtggggaaatagataggatgttattgttgaattcgtgcttgaggatcagctaggctgcaaaggtggagtctctcatctgatccagaaggggtagaagagtctgcacaagcttctgtgcacctgggaatgtttcgtgcgttgagaggagaggtggggtctcagcaggaggaggtcctgcaggtggtgctgcaaggggtcggctggccgcagggaggccggcagcagggggactgcacagacacaggctggcagcaggtggtggcccagcagcagggcctgcacaccacagccgtgcacgacgaggggcagcaggtgatggggcggcagcagccttcctgcagggagcaggggtcgcagcacaccgggcggcggcagggctcgcagatggggcgcgtgcagcggggcacgcaggtcacggggcggcacacggtggtctggcaggtcacggggcggcagcagcaggggtcgcggcagcagcagggctggcagcagcctcccccgtagctcagggaggacaaggtggagccgcagcaggagccggtcatggtggtgtctgaggctggtgtgggttgggctgttgagaggag

SEQ ID NO: 1583 - DNA, 194664 bp, Homo sapiens
cagtttcaagattgggttatttaattctacaattttgacagtgagatatttgaggatgatgctttacttgtgacatttgaaatgaattacacttaaatgttaggatttctttacatgatgctttatctaaatcattacatccttatctttcaaagaaaatcatggtactatgtatgtgtgaaactaaacatttaaaacaatttgttttattatttattatagaatatactttttaaattgtaaaaccaacctatattagtttccataaagctgccttagggaactatttttttaatatgtggaaaatacatccaaactcaatgaaatgtttgatatatagttagcttatatgtttcatagagttattaacataagtattattaaagctcttcccttttggttacattatttttccacatacagtgaatcaaggtaacaaggggtcgtttttccattttgttttctgaattggttatttacacttttgaaaccacaaagacaactcccaagtctccccatattttattttgcacaaatcttgccaataactcctcagggctcataatctaaatctagaggacattacagaattttttttttctaagagttttcaaatgtgcttattttcagggtcctgacataaggaatttcattattgcaagttgtatgtaaaatataaattaaatgctagtacatttaactatgaagaacaaaatttctttagtgtataataaatgagtagagtcaactcaaatccaatatttggaatccagatgcaccttgtgcaagaaactatatgggttgcattcagtggagtgaacagagtaactcagttgtatgaaatcagttgttgcattcaatgtcagtggcccaaaaaacttggggtaaaataaagactctatgtcaggtgtctggtttggttttcattttagtttataatgcttatgtaaaggggtaagccaagaagattattcttgaccacacttgaaaatggactcaattactgaggttaaatttcagtgtattttataaaaaatattactttcacagaagtgaagagatacaatagcacaatggtggttacaatggtagaaatacatactgccaataaaatgttagcaagagatttaaaaatgactgtacagcaccgcatcagagaattgtgttaacagcaaaatgattaatattatttttcaatataaatgaaatccttacattttttaaagaaataaatgggataaaagtgctttttgttctcctaattcctaccaaaatatttcctgatatggagcaaaagacagtaaaaaatgacagttttaaaaaaaaagacattcgtgcatttaagccaccattagtctctgactctaatataaggcagatcattaatctcttgcaaaactatgactttagccacttaaactctttttttttttagtgcttttcatgacaaggacatgataggccttgtaaatttagaagttaagatgtgtttccaacatggtaagttagacaagctcagctatgtttttgaaacaccaactttacaataaaaatgctttgctttggagaaatgatgaaaaataatagtgaagaaaaaaacggaaggggtcttatagagtttatcacaaatcacactgtttaaatcaatgaaaacatgtcacatttgcctatgtgtcatcctctgtcttgatgatatggaaaagggtgacattgaacagcacctggtggccattgttccaggcatagagagctcgatctcttgcattgtagtcaagcatggatatgtgaaagtattggttatggaagggaatgtctgtgtactcatatgtggaggttttggtggaataggaataatacaccttggctccagttaagtgggagttggtgacatacagtgtcccacagatcatgaaagattcccctgcacttctcttggggtagccagtgctccagctcttcatcacctccaaggtatcttggttaagttggctgatgacaatattgcctgcattctggttagttgcatacacagcccacagcccgatttcatcagccattaggtcgatgtcagagaatccaccccatgtgtaggggtaaacattatgaaaaccagcatactccaggcttcgttgggcaagcactctccccatatcaaagctgtatttgatgatgatattactctgatacttgttaaaatagagtgagccattgtagacaacatggttagttcctgcccacttgaaaggaaggttgtatgtccttgattcagccccactgacaaagtctgcaattgatttgtattcacgaacaattttattgttagtataactgtccatgtaccagacctgagaagaaggaaaaaaataaatggagtgactaaattctgtacttttctgataaccccaaaagaaagacagtgagagtcaacacttattataattctcaggctctggaagccacactatcttactgctgacctgccgcaatgtatttcaggcttttgtaaaaatattgctatggtctgtccatgtggaaaagaaataactgaatttactaccttgacattaatttgcttttttgctttttctctctttgttttttaaattcctgaccatttggtgcatatcactgagtgaaccaatcatatgtcaatgcaaattacacctgataaataatgccatcagtgaaaactacagcaaatacaaccttcagcaaattacatttattctatcccttgctctgaaaaaaatgtatagtctagtttttcgtattcaattgaaataagtaccatagaatcttctagaaacacttgtttattgggctagcctgtaagtacaactacattttaaagaaaccattttactaacttaataactaacctcatttagaaataaccctagagaatcttaatttttactgagttctgtaataggacataaatagagctatggcaagtttctagtatattgatttatatagcacaggcattgtcaacttatgaaaatacctcccagaagtttcagcgctatttcttttaaaattacttctagactccagggatatttaagcttatttagtaaattggttttgcccttgagtttttcacttatttagtcctattttttcatactaaagaacatattttagaaagagtaggcagggaagtttgcccttgagtttttcacttatttagtgctatgttttcatactaaacatattttagaaagagtatacaggaaattagcccctttcaagcataaaacatgactaaaatcaataaaaattagatttgctaaagtgatgaattggaagatggaacattttactaaaatagatttgtcattctttcgtagatatgttaatattatcaaacagaaaatatttgcaaattatgtaccagttttcaagtacaaacaaatatccctgaagaaaatgaatagtccagaagagaaaaagtgtaagcagaacttaattctaagcaaaggtgtttgtgggagaaacatactctgttgtttttctcagatgctaaagggtctgtcatccaagcaccaaatcgggttccagatgtcttgactgtaactgggcctgtgattttcatcagtttgccacatgctgaaattagagaaacacaaacgtgttaggtgaacgcagccaatgattccaatacgcatactcacactaagagcaaagaaggggatcataaaactaagccaatccatggaattaatatcacatttctgaataaatgattattcacaatgggtgctgggcctttaaccaaacattgaaccatgaggagttgctttttcaatgctccaaattttaaacataaaaatttaaagtgggaaatgatttgtacaatccggaaagaaataaatgaggaatatcattatcattataccagttcagtggctgctacttttaagtaaaaagttagacaaatgaagcaaattgcccatagacctgtttagttgatggccagaaactccttcccttcccctgtccccatgctttgtgactatggataacttataccagccagaaaaacactaccaattgattttcattctgtttggcaaagaagaagcccccaagaaagataactttacagtctataagaataaaacattcaatcacagtctataagaaagaggtagagattttaaaggtaaatgccttatacagctaacaggtctgacagggcagatatgaacacacaaagaacaaaacccccaaaactcaaaccttcagaccctgaagtcacatacagatgaaagatgaagagatgtaatacgtgacaaaaagactttaatgaaaaaagttgtaatatttttatcagcccagcccacctgtgaataagatcttagaaatagcttggacttcataaattccaaagccaaaaccaaacagaaagctagacatttttgtgagattttaaaaaaagattactataaagttttaactgtattttaaaataatgtttttgtccctttacctggattatattagtttgggtcacttattatgcttatctttcttttttatttattttaagttcaacttttattttagggatacatgtgcaggtttcttacatgggtatattgcacccaggtagtaagcatagcacccaatatatagttttatgagatttttgaacagcaaaatttagaagtgatttattaatcatacacattgtgaaaggcaatatgactgcctataaaatgttgggttttggtctaaacaaaagtcttctttcttgtccatttatatcatgttattttcttctatttcttttcttaaaactcttttgggtcctacttgttctacatatcttctttcctcctctgactatttagaattgatcaatttctattagttcctgttggttcttgtttttttggaaagaaaagaacacatacccaaagcaaatcaaagacaaactaactataacttgaagcttattttggctcagttttctctatatgtgcttcttataagaataatttataattggcagaatactaagctttgcagttaggaagatgatgaatggtaacattatattttgcactactagtttagtgataactacaaatttaataatctctagcatttcataaaacttgaatcgaatatatttttccctttttgtaaaagaaatcaaatgtgatggcatcattatatccatagtgtgggttactttatgatttcctcaaatcagtaaaactggaccaataattcagaagactttatgacattatctatggaattgcaagaccttgcattaagcctatttagaatatataagctctacttggtacaaatacataaacaatatatgagtaaagtagtattggtttgaactagaaaatgttaatcatattctgaatggttctagttgagtatattttctgaatgcagaataagtagaagtagtattatttttaataatgtcctatatacattttttaatcaactgatgatatgagcataacaatttcaagtgtaagtagagtgtaacaaatagaagggcctctcttttcccctaaaaacgtcataaaacatgtgattttttttctaagcatggaaaagtaattctgacttaagatgatggagtgatacatgattttatctgctttcattttctatgatctcattaaaataatagtaaaggagtaaaacatgaggggaaaaaaacaaaagaaaaaaagcaaagcaaaggtacaagagccattagtgaagaagttttaaccaatttccagaaggcagggttgatgaaaagtggtcattaaagatgaagatggaataagatgcatttgtgtctatgcagagcaagtgagacccgaggagggagatgatctgccttgaagagaaaaaagaaaggagtcagaaacataagtagaaagaatgctaggagtgagatgggactctgaaatcaggcacaccacttaaaccatgccttaagagcaattgattacatcttcatctgtagatgcgggactgcagaaggcaaaggaaaaaaaatatgaaactgtgttggtgatctgagtatacctagggtgattaatacagacattggagggccagaagaaagcctcctacacaatgacgttggtggtttccctgcctactcaccacagaaagaactgccaagccctatcttaataacaggagtttccaagcacatttattgttcaaaactttaaaaatatatgtataaccgaggatggccagatattttcaaaaagtttgtaagaatgactgatgtaaatgttcagaaaaaccagggctccccacagaagagataactcagaggatagacaagatcctagtaccttctaagagatttgtataatatatactgagtattgtaaaaggaaaacacaaaagaactattagaaaacaaaaatataattatattaaaaaatagattgcaagataaaaagagttatctccaaaataaagcaaaagagataaaaatgaaaataagagaaaaaatatggaggcatctaggatcaatctagaagctccaacatccagagagcaaggtttctagaatgaaaggagagagaaaaagaggggagaaaattatcaaagaaattatacaggaaatctccccagtaacaacacctaaatattcagattaaaagaacacatgataatgaatgaaaaaaagatctactaaaagtagttctaaaaaactactgtgaaatgttagaagattaagagtaaattgaaatggaaactttttagagaaagaatatgagcttgtcacatgcaaacaggtagaattagaccagaattgggcttctcatcaccaatactggatgctagaagacaatgatgagggcctttatatttaggaagaaaatcagaggaaaacagaataaagatattttttaacatgtgcactttccaaaaatttacctacaatgaactctttcttcagaaattacttggggatatattgcagtgagtacaccaagacaggggaagacatcagacaagaaaatagtgacttcctgtcccagaatgacaactatgcagtgggctttgagaataatcagcccagaatggaaacacagttccaagagggaggtctcagaaataagtggaattgatacatagatagactgtatgagatcctctagagaaactgggtaatgcagaggcatttattgatgtatacaaaataattcacttgaatttaactctggtaatagcctccattgaatggaacaaatatgacattgggcttaaagaggaaggaaatgtgtctaagtccaccacttagctcccaaggaacaatataaacattgctataataatgtaaacactcatgtctaacttgtagaatcagcccataaactaattacataaaacttcttacagatctcatctgctctgtgattacaggaaagccaaaatgtttccaaccatgacaacatggaagaataggtaaagtccacgttgttagagaattaaacattgggagaggaaatggaaagaaagatgggggtgtaactgtcttcgtattttaaaaatatggaggtaagagatttttcctattgttgaaaaataatgaagattcaaatctaagacttgaaattacaacattgatagggttgaactgtgaatagtcatgaaatcatattaggaggaaacatgaaagaaagcagagttggagaagttatctaaatcctcatcttgcagagcaggaagtcaataaacaatgtctaaaactgtaaaccaaaataattgaagaaaaaaagcatgttaatataaatatagacataatcactaatagccctaaaattaaactgttaaatgtggttgaaactgcggagcagagctaaagaaggagactactgctttttattctaagcatacaattttccagctacacgcatacaatatttaggttataatgtaaaaagttgaaatagctgcaaaaatttagtagcctttaattttataaagcaaaaatcacatttatatattcccttttgaaaaatcatttccaggttttacatgccatgcttccttgggaccaggaagtagatgaaaatggaagatgtgaatagtttgcagaagtggaaactgtgaatattctgcattttaatttggcctttatcctgtaaggaatagattgaaactctgttctttaaacttttaactcttactattgacatagcaatctcttgctctttaattctttcaaccttaaaaaattagaatttatattatgaattataatatttatcacttaatatatatatcaaagctaataaatttacagtggttagtaaatgtgcaggagctgtaataaaagatactgtacatatgattcaagtatgaatgatatgcattttcaaagtagttaaatgattacaatcttggaaaaatatactcctgttgaagatccactagttaaaggagaaaatgttagtctaaaacttaaaaatattttaaaaatgtgaatgatttttattattatttgaaaaaatatacatacacaggatctcagaagtcagttgagtccaattttgttctgaatacagattaatacaatgtctcgaatatgaaacaaacataatgtaatgtgcattcccacaaaactttatactcagaggaaattaccaagcggaaacacaatctgtaaaaatttatggcaacttcaagttctttctattgtccaagtgaatacagattttgtagttatggagtttgacttaacattttagatggccaaactaatgacaaatgggatctaattaaactaaagagcttctgcacagcaaaagaaactaccatcagagtgaacaggcaacctacagaatgagagaaaatttttgcaatctactcatctgaaaaaagctaatatccagagcctaaaggaactcaaacaaatttacaagaaaaaacaaacaacccgatcaaaaagtggacgaaggatatgaacagacacttctcaaaagaagacatttatgcagccaacagacatatgaaaaaatgctcatcatcactggccatcagagaaatgcaaatcaaaaccacaatgagatactatctcacagcagttagaatggcaatcattaaaaagtcaggaaacaacagctgctggaggggatgtggagaaataggaacattttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacacgtatgtttattgcggcactattcacaatagcaaaaacttggaaccaacccaaatgtccaacaatgatagactggattaagcaaatgtggcacatatacaccatggaatatatgcagccataaaaaaggatgagttcgtgtcctttgtagggacatggatgaagctggaaaccatcattctcagcaaactatcacaaggacaaaaaaccaaacaccacatgttctcactcataggtgggagttgaacaatgagaacacttggacacaggaaggggaacatcacacaccggggcctttcatggggtggggggagtggggagggatattattaggagatatacctaatgtaaatgacgagttaatgggtgcagcataccaacatggcacaggtatacatatgtaacaaacctgcacattgtgcacatgtaccttagaacttaaagtgtaattttaaaaatatataaaattaaacttcaaagtgaagtttgatttaccagcgaaactgcctcctatggtataggtaccttattgccagactgaagcatgatttgtacaaagcaagaagacacaattctggtatttgtctcaaatgtctgcatatttcagatgttgaggtgtgcataatccgatgttgattagttgaaacctgaacaagaactgtccttggagctctgaatcataccatgagccttatctaatcgacatttccaaacaacccacagcacatcactggcttggggtgtctttggcttcgatggtgcttgaatctaatccagccttgcatctctatggcaaagggatactgctgagtcttaggttgtttcggccaaaacttaggacagaatttgtaccggaggttaaaagcttctggctcttaaactaaacattgggtgaccatggtaaagtggtcttttggctagttgactcttttattttgtacctggttttgtgaggaaaattgattcttactccagtcaatcataccttagaaagcaaactttactttcttgtagcactaagcatttctctgaaatatgttagagggtaaaaacaatagttactatttaaagatataataattaatttattcatttgacaaccatttactgtgaacttattttgtaccagaactattctaggtgctgagaatacaaaggtgaacagggaggcaagtcgcgtgttatagcttcccaaaatactattgcttatgcttctcctttctgttgccttttttcttcttcttttctcttttttaaatcaactggaaaggaaatttaaagaaagaagttatattggaccaaatctgtattgagaagaaaaggacatagcaatgagtgcactaaatatttgtcaatattaaataaaaattattgaaattcagtcatgagtactgtaccataacagcattccgttaagacagtcttcttagataacctgaaatatatcttatgtttagccatatttgcctctactcttcttccacaaaacatactcataagctgtcaacatagaaacaagcaaattaaactactgttccatgtttagtgtttataaaaaatgaatatgtgtgtctagtaaaaaaatcaaatatagttatatttcaccatagctcaccgatttgttcctgcacacgtgtcttaaaggtagttgttctgtctgtacgatggaaacttatccctataatcaggaaatcaatatatatctagtgttggccagggaaggtcttatgaacacttatgaatttagtgttttgcattatttgattctcctctgtgtaatcttctctctgtcaggttgcttcatgtctgtcatccattagctatcttctctctgaccagtgactcaaaatgcccaattgcaggctttgtcttcctgctattactctttatttgacctcagtccatcacaacttttattcctggagtcaaatcctttgggtaaactaatatttgtagtgttaatctaagaaacatactttaaacgaagagttaatgtcccaaagcattaacaatttaaaaataataactgcatcttcggtttcttattctgaaatagtgaatacattaaaaatattacactccaaagcaatacacttgcttaaaacccaaggtaggtatatgataattatgtatgaaaatgtcctttacttttcactgagtaggggacaaagtgctttgcataaagtttctccacatttgatgaccatgtaaagtggtcttttggctagttgactcttatttttacctggttttgtggggaaaatagattcttactccagtcagtcttaccgtagaaagcaaacttttaggtggttaaaagaacagcttttgtatgtgacctatgtgcttcattcatttatttattcattcacccagctaaggtttttttttttttttagcagaaagcactgttccagatactagagttaacaataatgagaaagcatgacacctctgttctggtgaagcttacattttggtgagaagacagaaagaataaattaaaaaacaaataaacaaacaaactaaacatatcatacagaaataaatttaatgccaagatttaagtagggcaattttataaagagtgactggggagctacttgatattgggagggtaaggaagacctctcagtgtgtgacatttaatttgagatcttattgacaagagaaggacatttaggcatttagtttatttactggagcagttgtttagtggatttagccatttagagaatagctaggggaaggcagcatcttaaagtggttggggacatgggttaaagagtcggcctggatttgaatcctgattttatcccttattcgctggagaccttgaacaattttctaacctctcagtgtttcatgggtaacaatagaaataatatcgtatcaaagtgttattgagaagattaaataaaaaatatggctacatgtttaaaatagtgcttggtacatagttaagtacttaagaaataatagctattattattgttattgcaaaggccttaatacgcttgatgaattaagaggagcaaataaacagaaagaagatcaatgtatttagaatacacttggaacagaagaagacgagattggagagatgagtagtccagtagtccacattgtttgtaaactttgtgaagacaagatttggattttattctacgaatgatcgaaagtcattggattattttaaagggggaggggaatgacagaatgtaagctgcaccttagaaagatctctctagctactgtatagaatattaattgtagagtggatagagtgtaaacagtctcattaaaaggttatcagttttgggaggctgaggtgggcggatcacaaggtcaggagatcgagaccatcctggctaacacggtgaaaccccgtctttattaaaaatacaaaaaaaatagccgggcgtagtggcgggcacctgtagtcccagctactcaggaaactaaggcaggacaatggcatgaacccgggaggtggaacttgcagtgagccgagatcgcgccactgcattccagcctgggtgacagaacaagactccgtctcaaaaaaagaaaaaaaaaaaaaaaggttatcaggctgatttaggtgaaagatgatggaagcagttgtggagatggagaaaagtagatggacttggggtatgtttttagaataaagtggataggactaggctttggattagatgtgaggaaagggaatttaaaaactcaaaaaaaaataatcaaagataacatctagatttttggcttgtccagctagacagattgtagtgtcatttactcggatgaaatgactgagggaggaatgggtttgggagcaaaaataaagaatccaacagggataattctaagttgttcatgactattacacgtatcagtagaaacagcatataaatctagggaacagatactcctttgagttttgacaaaacagttttgatggtttttagcataatgatgacagtgaaagccaggggctacatattgcctcagagggaaggcatacacagaaaagagaaaggtatctagcacagaactctgtaaatcacaatatttataagactcatcaaagaagcccaagaataagctataagttggatagaaaaaataacgtggtattaagaaatccaaaagaagaaagtgttttaagaaggatatagtactgacctgtgaaaaacaccactaagatgtctagcagcataagatcaaagaaataaccataaaatttggcagcaagagtcactgctgattacaaaactcagaaaaagtgtggtgatcccagaaaatgaatcgaagttggtttgaaaagaacgtaaccaaagtagcagctataaaagattctttcaagggaaaagaagcagggagacaggagtaggaaaatatgagattacaggaagtttttattgttgtgctgatgatggttaagaaaggtttgtttataaaaataatctagtagggagcaatacgctgatgttgtgaaagacaataattaaataaatgaatcccatgagcagatggtagtttaatctgtttagtaaccatgagtaatcatgtgcctatctttccttttataatttttgtgtgtgagtgtctgtctgtttttactcccatcaatttcacaggaaatgttcttagagtggtatattccatccaggtttgaacactgaggcatgagttaggaagcctggtttcaaatctaggccacagcattcaatcattgtatgaagttggacaatgccttattctctggagtggaatttcctcatctataaaatgaaaattctgaagcttgacattttttcattttaactaagggaacattgaatagatagtggatcaatagcatgtatatgctggtggacagaaggtggtatttgtggttgtggtcaaataaacaccatcagcgttatgtttatgatcaccatcatctacccttattctcaggaagcaaaaagctgacagagctctcgatgttgatttcttcttagtagatgcttcccttacaaatggttattgatttcctaagctagaattcatcttgccaaatgaaattaacaaaattaaagttacaggaatgtataaaactggcagtgtctttgtttataattttgtgtaccttagtgttaagtaacataggtatctccagattctaatggagcatagatactgtaaaatgtggtaaaataaaataaacaataagagtcattttttacttctcagcttcctcacactagcctttgttcaaataaatcattatctttctcactttactctcactttttatgaggacaaagggagccagacagagaggataattttcccaaatgcctggaagacaaatgttcctgcaaaggtggatggcaaagaaggaagttaggagtcttgcttcattgattttctcctgctatgctcttctgtctgcagtaagatatgaaaacattagcatttataaaatattgtatgtgcacattgcatatattcagaaaatgtactgaaatatacatcttaccaaatgcagtaattgaagaaagtgaccgtgaccattttatttctatcatgacttttggactttaaatttcttatagtcagttacaatccatatttatcaatcagtagctcaggaaaagatatcatttgggattcagcaggaagatcagttgtttggactaacgaagtgtaaaaaccatctgtcctctcttttatttgtttacatatatataattatttcttatataattgtactctgtaatatcctgcactaatagctctggatttgaatcctaaggctatgcccttataaacaaattaaatggattattgaatatgtttatggacagaatgttatttctttttacttaaggccattagagaactcatgcattaagaaatacttctgatttgatctttaaagtctacctatttaggtacttaaaataagtttgtctgtaccatacatttggtagtaaaataaatttatattatttaaacttttatttgcatgtctagccttatgagttatatttgtgaggtaaaggtagggataagaatggatatttaaaatgttgtattggatagagcaccggaatgagtttctaatggttatctggctaatgggatcaagaataatatgaacattctaaataaccaacatttttcaaagttaacacagtttcaccttttaaattatttttgaaactcccttgactcttccttttaccttttctgggattaagcctaattatgaacatatctttaaggagaagcctgttcagcattcaaactgaatgacaacttgtgttatgaaatcccaactaattttacaattcctacttgactttggaaatacaggttttatattattaagaggctcataacttagttataatctagaaaaatgtaggagataagaggaggattaatgataaataaatatatgataaaatttaccaattaccaaaaatatggctaaaatataactaaggttccagagttccagaagaaagaataaaatgcatagcaatggagacattgccattctattttacaacctagaattttgggaagagcaagactgtttttggtaaatgacttatttgaagattcaatttaatttaaaggaatagtcttataaatttcctccattgcatttctgagtcaaatctcccacatctctacctcaggcacacagcttgacttttttgttaattcctgctttcactgagatctttcgtgtctcttgctttaagtgctaataaaacaaagtatcagatgttttggaatgaaatactgcattgccattgaagagagaacagttggcaatgacaacaaacatgaaaaaaggctgtgcttttattttccttccccccaaaagctttttggctttgtaaaagatatcgatgtgttttatatttgacacacattgatttatttcttgaaagcaacttaaagcttttgattttacaaatcaaatttgctcttgaccattctgcagatactaatttttgtccactgtgtttcaggtatattgcaatggtctccagaaattcaactagaacaagacattgattctgatctctcagtgcagggagaatttatctataagggtgtaaagatttaaaacagaaaaacaaatgggcattttctgtaaaatatgttaatgtactaagtgtcatgggagagtaggggaggtggttgtgggagaccatgccaggggactccaaccacattaaggaaaaatcatggaatagttaaagtgggaaggaagggtgtcccatgacaagggagagcaagttcaatgtcaagaaggtaaagaaagcatgcgcaattgagaaactggaagattagaatggttaaagcttagagtaagtgcatgatgagaacctgagaactcaaggcctggagaatcaggcagagcccatttcatgaagacaaagcatgcaaaggtgtttggattccattttaaaggtaaaccacttgaatacaggtgtaatataacaagatttgtattggggaaagatcacactaaatattttttagtgatggagagccaaaacaaatgatcaggaggccatttgagtaattcagttgaaaaatcatgaatgacactctgaattcggctggtggaagtgaggatgcagaagagctggttttgagaaattggtgagggggagataaaagatgtggcgattgcatggcggtgtgaagttcagagaagaattaagaatgaatctagcctcttttttttctacaacaattgggtggatggtggttctagtcattaaattaaagttattgaggtatctgggggggtctttattattttgtactccacaaaagacattatgtatggggaaagaaatctcagtctttgaactcagaaggacttccatgtaaagtgattgcctctaacatgaatctttggcaagttaatttaaactttctgagtatctgttttagtgaagttgatactaatgcctaacccagagttcttgcatagatttgaaatagcacatgcaaagcagctggcctagcgcttgtcaagcagtaggcatccaatattgctggagttattgacttatgtgtcagttgtccccactaaaatataaccttgacaggaagaggaagatggtctccttcccatccttgtatccacaaatacctagcaaagtgccagcacacattagagagtcaataaataattgttaaattaaaatattagcccatagatactttggttcttgtttaaaaactaatttggcataaacggtaaagacagtaactcaagtctctacttgtgaccttaagtttctaatcttccttctgttaaacatgaagtcccaaagctgtgtaatagaacctaatgcttcactagatggcaccaaaccattgccctaaaacagcactaacaggagggagttggggcagaggactggaaagctggaaagccttattataatctacattaaatatctatttggtgttcttaggggtgtgtacaaacttcaatcatgttttttcagtcaaattctcacatccatacaattacattctgcatatctagaaatgtgacatgattcaattaagaacaggggactttatcctattccatctttcattggagtacattaagaacttagaaaaggacattactgtacctcattcaggccagaggtccatcgctgttgagagattttcctaatttctccaaacctttaattttctagtagaaataagcaaaatggtgcccatggtgccccagtggtcttgatgacttatgattccttcgggatcttatttactatttgggggtaacctagattttgcaggcaataagactagcttggtttttagcatcttaaaattcatgtgatgtatgctgtgacatttatttaaaagcaaatccactgaaaaagtgagggaaaacacattcatcattgttgtaattttattgtttctctctaatccatttctaccctctactaattggctgtgtgggttgagaagcatttgtgtagagtgaagatgtctttgatgaataagccttcttgctgttgttactatattgctgattctgtaattatccaatgtcccactctagatctgagcagcatagcaactggattataggcccttttggaacaactgaacccctgatatgcttttctttctctaccctttctgttaatggtcctgatgttaacatcagttttcttccccaagtctatgcattctgatatatggataattgggtatttgtttatgtgataatattagccttggagttcaagggttctcagagatgaattgatccaaactgtaccaattgccaggaaatgtaaatactaaattgagtgttaatcaaactataacctactgctatactaaaagttatatatttgatttcttctgcaattgtctatatacatacatatatttatgcactatatataatataacaacatatataatatatactaccacacatcttctttcaagtagagtggctcttttaaaaataaaaatatgaagtttcatttatttattttttcagtaaccatgtggctttatacttcactgtataatgactgtatggctctgcctggacgttttctacattgtaattaagggttgtggtccagcggataaaatatcctctttgctcaggagatgctcaataagtggttaattgacctaaacatgttgggatagtaaaaactaaccagttattgagataaaaagcatgaaagagttacattcattgtttgtgacaatggcccctctactaagtaaataagaaactgaaggctgctaataatctatgaaagcatttatgaaatgtgggaactattttcagtattttataaagtcatctcgattaacttatatagcaaccatctcattaaataagaaagttgaataccgattttattgctatttgatatttgtattatactagttgccaagttttgttttagattagctaaaataaaaataaatattgattaactaatgcagtttatttgacaatcaaattctttctaacattgtggcccactggataaaattaattaaaaagatctgtgatgttacagatattaaggatcaagtcctaagcataaggatgctatagaaatattatgcaaagttcaataggaagaataaaaaggatgaatgcgtgcctacttagattaactatctttgtccaaaatatcggaagaggctatatttggggggttacatgtgggttagaaaaaacaaacaaatggggttaaaaaagagctgaggagaatatagaactacccaactgcagtacaaattatttccatctaggtaaaccagacagaatacctgtagaaggaaagctcatttataaaattgagcaaatcccagaagttgttttttgtgttgttcattcaaaaacataactgacatacgttaggtttcagggggtttactaactagaatcatcctattgcctgtccttgcttcagtagagtgcatttgtacttagcagatgccggctcactacatgcaatgcctatgtgcttgggtttattgtgacatgctaggaagagtgaattgattctcagggtctggaacggttggtttctctataacaaatggacctcctcctcaaaagcaagtcaaagccctacacagacaaatcctacagattgtcacttgcagaaaatctttaaccagatattttatgagctaatagaaaatgcatctggatatttctttgtaaacttcatattgttgaggacactgggtaattcttcatttgagatttacttgttatcttattttatggagacaccatctggcaagccctgtcactaatatgggcattaaactaaagatatttcttaatataaaaagaatcaaatataacagcagaatttccttatgtaagcaatgtttacctattgtatattaaccataaactccacaacttgaattataaaagcagagcatgtaaaataattatttaagtgctatgttaaataaataacttttcccttgcttagtcttatcatgccctgccattttgactcaaataggatgtggctaaaaagatgcatttcttgttatgagtaaaatagatcattctctgctacttgaaataggtaatatggttgaaaagtgtagaaattattcctatgactccttatagagtaaatttattcaccagatatttattgagtgacttttctttgccaggtagttttctaggcattggaagatacaacatgtagagtgaacatgatagacattgttcttgtcctcggaaaaaaagtctagcaagacacattatgctacacatgcaatgataatgaaacaagagaagtccaatcattagtgaaatatcaggatttggaagtgcctagcgaggacaccagcttagtctgggagggcaatgaatgattctagcaagacacaacatttaaactgagacctgacaaatgaatagtttatcacatgtggcaggtgaaagtgcgttgatggaggcagggtacataggggaaggagtgtttcaggagcaggaacaaacagcatcttataacaactccatggtaagacattgtaaggcacacatgactgggacttagtgtgtgaggagagaagtggcaaaagctaagcctggagaagcagaaggggccacacatgaagggtcacataagccatggactgtatcctacaacataaggaatccataggagattttcaacagagcaaaataatttcagattgatacttcagaaaatccctttggcaataatgtgtacaatgagttagagaggaatgaaaactggagtcacagaatctattatatatagttgattgttagaagaccaactgtaaatgagaaaatgtagactgtgtttgaggaggaataaagaactgaggattcttgaacatgtgtttcggccttcaggtttaccttatttcctcctgattcattttgttggattctcttagaaatcctggtatgatgacagtggagcctccgatgtagcaatttcccacactattttgaggctgtgataactgaatgcaacattttgcattttggattcctttttatcacttgaagcatatttgtaaaatagtctttacaatgttcttgtaagccactcaaattttattttaaatgtttacatttattcactgaagttttctttactagaaattaatcttttgtgtgtgtgtgtgtgtgtgtgctttacttctcttcccaattttcctgatccacaaaagaatttatttatcttgagagaacactttctatgggtattgacttgccctccctgtcatatcgcatcatgtcaacaactaaaatactgatcctaaattaacttgtagctcctccttattcaattcatagccacttatttattttaaattcaagttgcagactagtcccatgttgacttcagttaaataattagctcatggatatcacgaaagagtttgtaactcagaccagattggaccacacattttaggaggtaagaagtagagtccatgacccatgcatgtcacatgcttgactctttacacagtggtgagtacctatttaagtagctgccaccttttcatttcttgagtagatcagagcagttgatggcaattctgtaaattggaggaattatttccatttgctttaataattgctgtttgacatttggtcccagggtaactttcctttctctagtctccaaatttccccactaaccaaacaacaacaacaacaacaacaacaacaacaacaacaacaaaaaacagtttctttttccactagccaagcaatgactgatatcacatattggaaaataaaatgtatatccactagtgtagtccatagagttgactgtatttgccagattacttatttgaagccaccaaatggtaacacagggctctaaaaatcaagaaaccattagtctagcacagagtacccagacatgcttaagtcattaggggacacttcacacttagaaaatgggctctgatttctttacaattagatattttatgactctttataaaacgtaagagcacaattttctttgaaactatataaaaacgtaacttagacaaattaaattgtcatactcacttagctttttcatgcagtcacgaagtcttgtttccaagctcagcactctttggtgtagttcctcgtagtcataggcaccaatttcctcctgaataccagtgaggacagcagacagattccttatttcctccttgaactgggtgattaacttagcatctgttttgtactgttccagcacggggatcaaaggcaggagctcgtccattttctctttcaactcctgtgaaaagcagcctattgttcctgagagtcatttaaaacagatcatgctgctctgttctttttattatgatacttaaaggaaattattaaaacagcttcaacatttcttattgatttttggttgaaattaggtattttgtgaaaatttaagcggtcatgtgattattactagtaagtccatttatttcagcttttccatatgagaatctttctttaatgcttagttttctataacaaatatatccttatcataattagaaaaacttcctatggtagaaactaggactatatactatttcattttctggtaacattttatatagtgaacaatgtattatctagttaggaaatataagcagaatccatcttctaattatgaattaagtttgaataaagtgattgaaaataggtcaataccctatgattgttcagttgagtctaatcatccacctactaagtatccatgttatggggcacatacagaaaattgtggactctggatcagcttttttctgacacttagaatttttccatcatggccatcaaccaactttgtttttcctttgtgctcaggtattccttgaacttttaaatatcaattttagcacaacttcattatgaaggtaagttcagtaagtgttataaatcagatgaagtgtcccaaggctcaaataaaggtatgttactgtttactattttgaattattacctgtacttcgactccatttatcttaccatagataatttaaaggtcgttatgtatggcagaattgcttgcccatgtggcgaattaactctttaagaaaccaaggtgtgtagtttatgtaatagatgagccagttacacagagttgtttgaaactgaagcattgactttcgtcaaacacacacacacacacacacacacacacacacacacacacacacacagtgtatgttgtcaagcagtatccctcacccctagccgtaacaggactgaagcacgcctacagtttcaccttgggtttctagacatgtcaccgttacttctttctctctaacttcatagtagtgaaaatagtagtgaaaataaataaatatttctttatttatttcaggagtttgattcaattgtgaatttattggaaataatgtcatttgtggaaagagcagtccctcttatgattatttgagaataatacatagatgctgtcagaaattatactgtacactaactgatttaaggagctgaaaattgcatttttaaattacattcaggagatgttattactataaatgcattaaaatagcaggagctcccattgctgccctgatttatgggtttgagtttcttgtggggaaatttccacttgctctgtaagttcagaatctttgaatttgttcacatgtacatattgagtgggaggctaaggagagacttaataatgagaaagattcataaatatcacagtcaaaggcagaattgcagtgctttgctcattttgtcagctcatttggaaatagacttattaaagtatcttgtggtatccctaaaggaatacacaattgtttcattaggattttaatgaaaatatttctgtggttatcattttctgcacattataacaactgttacaatcaaaggttttacattctactatgggcatatttaaaagagagcaattcaatgtcaaaatgttggtagcttttcttctccctcaattcaaaactagatatttatattttttaatcttttcaacaattcataatttgattattagcgatcaattgtgaaactctgaaaacttatatgagagcattggaaagtccacccaatgctcatatcaaatacttaaaagattacagtagaatagcatagacctgtgtttgctaatctcttctagaatctcactttctactatgctgcttttacatccaagttcttagctagagtagagccaacatcaatctcttcatataagaatgtcaatctcaagtatagtagttggcataagctttctatctgaaaaagtgtagaagacaaaacctacttaacattcttgatacgatggaaattgtgtaacagaggaagaattttttttttttttgagacggagtctcactctgtcacccaggctggagtgcagtcagtggcgcgatctcggctcactgcaaactccacctcccgggttcacgccattctcctgcctcagcctctcgagtggctgggactacaagcgcctgccaccacacgcagctaagtttttgtatttttagtagagacagggtaggaagattttttaaaaagtattcttcaatattgaatttactttggaacgttccatttcctcttttcaagtatagtactagcacctagaacaaaatccaactcatggtaggactcaagaaataaataaactccacaaatatatgttgagcacctaattattattatttgtaattcagagacctaaagtctacttggagaagcaatgcagcattagtattagaaggtacaagtttggaattggactttctgaatttgaatcttggttctcatgcatattagatatacgactctggataaattactcaacctctttgatatggtttggctctgtgtccccacctaaatcttatcccaaattgtaattcccatatgtctgggagggaccaggtgaaaggtgattgtatcatgggggtggtttcccccatgctgttctgatactgagtgagttctcatgagagctgatggttttaaagtgtggtacttctgcattcatgctctctctctctctctctctctctgtctgtctgtctgtctgtctctctctctctctgtctctctctctctcctcctgccttgtgaagaaggtgactgcttccccttccatcatgattgtaagtttcctgaggcctccccagccatgcagaactgtaagtcaattaaacctctttctttcacacattacgcagtctcagcacagatctttatagcagtgtgagaatagaccaatacactctttgtgctccagtttccttatctttaaaatggaaatgaaaatagtgcctgagttacaagactgttgcgagcattatacagttaatatactgaaagtgctcagaactataccttgaatatgtataatattctgaaaaatcattattgttattatcattactgttatttggattttgacatataacttcagcgtatacttggattacatgaactaggaaaatccaagccattatgtcacatggtgctgctgcctgaaaattgttttcttattagtagcctggctgatttgctgctaggcaatttataggactaggtacattatttctttggggtttatctcaattttgtatcctttttgtttcttagtttcctgtcttctcgcaaaagttcccaaagatgaacatgcttcatcatgcattccccagccctgtcaaccctgacactctcaagctgtcctttggctttgcagaattctcattgcattgtccatctacgccaaacagtctgaactcctctcctcctgactagttccttctgggaatgctcttcccacacctaaggtgccagcttactattttctactttgccgatgacctcagcattgggttcccattattattttaccatctacactctaaccctgagaattgaaaattgacatagtaaatcttttggttttcttgatccccctataatttaatagtggaggggtagggtcactagtacgaaaccagctcttctcctggtctttttaaatcaaaattaatttctcctccctttgtgctcataagtaatgtttatgcctctattcaccatcaattcacctgcctgttagttgtctttcatagaagacagattacgtataatacatccagcagaggggccaaccgcaccttgtatatggtatgtgctcgataaatactggctaaaattaattcttttgctcttcatcctcatattcttctctgtttaccatttatccataagtttcctatttatccagttcactcacactctcattttcaataatctttaaatttaagtatattctaaatcttgctctaatttgtcctaattacttaacctgctggttttgtgtacttctctcttcaatttaaacctcatgattaatcacttcagtcccctctcttttcaataccctcaactttcttgccctctttttcttcctttgtgaccgtctgggtaaaactttaaaaccaattcagggtgtaatgttcttctatacctctctactcagtctctggagtaccactgaagaaaattacaaaaccatgaaactttctgccacattcaaatgtgttatgcagagactcggttacatgttcctcactagctccccaccagccaccactatgtgtaggaagcactcctttccttgcccaagggcttgagttcagatccactccctcaacatcagcagtgaatctcacttcctaactgacaagaaaaccagaggctattaagtgggcaaccacagtgttttatgaactatgtgctatgcctaggtaaggcaagtggtttacttttaatgggagctgagattgcattagcagaccaagagttttttcttttctttttttttttgagacggagtctctctctgttgcccaggctggagtgcagtggcgctgtctcggctcactgcaagctccgcctcccaggttcacgccatcctcctgcctcagcctcccgagtagctgggactacaggcgcccaccaccacacccggctaattttttttttgtatttttagtagagacggggtttcacctgtttagccaggatggtctcaatctcctgaccttgtgatctgcccacctcggcctcccaaagtgctaggattacaggcgtgagccaccacgcccggccgagttttttcttaaaattcataactctttcatatatagttaacaaaagttgacatagcatgatttttttctccattttcagtatttgtaaataattgccaatacaacacttaaaatctagaaaaatactttatttggataaatttatgaaacaactctctccacatgctcatattaatggcatagttttctctttaaataatttatatcatctacatctttcttcatattagcagggcataaaaccattagagaaacatttataatttaattattaattttccttggggaaatttcccttgtttcagaaactccaccaaactctacaagaatgaagctttttctatagcaagacttccatgtcttcctaccagctaatggtcagtttcagtggagagatgactgaaatcccccatgagtcttttaccttgcacatatgggccaatgcacattcatttctagctgagtgccccactgctgtccatcccactccatgtctgatttggattgacaagattgcagaagtcaaacctacctgaaaatgcttggtcataagtgtctttcgatcatcttcaatctgccgaaattttgccttcagccctttcatttgggtttccatttttaaaacatattggaaatctctctgagttctcaagtttaagacttcaatagactgggacatgttctgaacctgttgaacaagaatattgtctgtacattattatctgtttgcaggtttgtgcaatcactaagaaatagcaaaaatgccgttaacataaaaactagaagtgccaaattcataactgggttcccatatgacacattttcagaagaacaattcttcattataaacatttaaagaattcagcaagagaaaattatacctagacaggaaatttaaaaacgggcattctagcattagaactgactgaatataaatgggcttaatacattagaaaaataagctttaaaaatagaattttcattttaaggctttgtaagctaataacatcccaacctgttaaatgtcaaaataagttgtttctgtaagtactaattctgacttcttaaatatttaggatgtttagcaattgtggatggtagtgaagtgtcgaagaggcctagaatgcattcattctagctcagtaagttcttaatgggtctaaagtactcccaggggtgagactgaattgactaagacaagtggtagcagtactagaacactccctaaattggacagcatagtgtttgagggacctggaaaagggtaactgcatcaagtgcttggtagacaggacttaaacacattttaagccaatggcaccatcccaggttcgctgaaccctgggctatttggaagtaaaaaagaggtaacctataacgcatgcagaaatgagaggaaaaaatgactggtctaatttttgtagcaacaaaaatctgaaaacaaagagaaagcatctaataacaggggatgtgttaaatagagaaatagaatatgaatgacccgttataaagattaagatagatctctatgctgttagtactcaaagcaacaattttggtatcacctaggagtttgtcagaaatgcaaaatctcagaaatgctcatccagaactactgaatcaaaatatacatttatcaagattcccaagtgattcctatgtctattaaagtttgagaagtactgctcaatatagaaagatttcaatgagaaaagcaaatgtaaagatcttcataaaatttgatcttttttgttgcttttgttgttgttgctgttttttgtgagacggagtctcgctctgtcacccaggctggagtgcagtggcatgatctcagctcaccacaacctccgcctcctgggttcaaaaaattctcctgtctcagtctcctgagtagctgggattacaggtgcacgccactacgcctggctaattttcgtatttttattagagtcggagtttcatcacattgatgactatcacctcaagtaatccacccaccttgacctcccaaagtgctgggattacaggtgtgagccactgcgtccagccaatctgtttattctaaatcaaatacaaatacatgcacacacatataatcagtaaaaagttattttcattgaaaacatgtgatttacaaagggatgacttgttcagacacaaatttttgtcatcagataaagtggcaatgctaaatggatcagccagctgtaaagttcccatagttgatacattccttagaactataatattggaaaaaggcaatgaatactgtcttggcctgcctcagttctttgcctttttttcacccttttctgttccctctgctgtcttgatccatcatcttgccctttttggatcctgtccttttaggacatattacagtctggcttatcttaaaactaattgtgttatgtgggtgtggagtaggggcagggaagtagccttccctttgtgagctccatgaggttagaagctgtgtcttactcatatcttccatttccaagaccttacacggaaccaggcacagagtaagtgttcagtgaatatttattgagtaaaattatcttgggtttgtaatagtaataataagtatttagaattttaaggagagtcttcctactcctgtctctggttaggcaacagcattataggaatgtaagtatttcttaatttactaaaagtttaatattccgaaagctttatttttaattttcaaaatatttaatctagcacaaaattactaagacaacattggaagcatggtaacgccattgtggataaatgcaatgctttcaacataactttctaacttcatttgtggttaaacatgtataaggaaaagccatttgcattaaaaaaaactgtctacgtatttaaatatggcatttgtctgtgaggacacctatcattagcatggctgatatcctggtaataattctatgtacctgggccaagtctatacaattagaaaatgatgggcaagataaggtattctggataaagttaaaatagcctgtctttatttctgcctttgactcaccctataaggttaattttcaacttcatttgtgttacaggaaaatgcactgagataatttttgctaaggcttgatggtgacctatattgcagaatcatgtgtaattagaggagctacatttggggtaatggctagagctagagctgtctaattggccaggatttggcttcaggtggtcttaagcatctcttgctggttataactaggattgtttagtttcccactggctatagaggcctacagagcatcagtttcctgatgacacgggagactgaatacccatgacgacatgagtaaggaaggagaactgtctgctatgttccctctttttgttggcttatctctgcggttgttctatgattcagctttccagaggtgtttctgtgattaggatctctcagcatagtttggcaagctcattgtcgcccttcctggataattcttttggaatttttatttattctggttctttgtataaataagatatctggggcttttctggacttaaacacaaattaactttgattttcactctcactcataattagtgaggtggtcacttgaaaaaaaaggtctattaattaaatacatttggatagccttgaatttaacacatataaaccgatttcttgactgtaggacttaacaaaaactttagtagtaaactgtgtattagaaatcttcaagaatgaagtatcatgtacaatgtttcttaaacttatgtcattggtgaggatgatggcagtgtcctattaaaaaaaatcacactttaggaaatattgacttagataatacaagacatctttaactgtacagggaagctacatagttaacaaacaaataattttttaggtgagcaattttagttttggcatactaagacctgaaatactgtgaaaccaattatattttttctaatattcaataatataaatacctgttaaatggcaaacagagcatcacttaaataagtatggatataccagtgggattttgtatgacactggtacagcattgagaaaatgcaaacggatctgttagagccacaacttactgattgagtgacaatggaaagttttcaacctaaaaaccaccagttttcttttacataaacttagaaagataactatcccttctataaggatttaatgaagtagatacaaaatataatacaaaatatactaataatgggaactattgttgtaaatattgtctttattaacaatattcccttatatgtgactaaatcaatctttttggttaaaagtgaaggaggtgcttaaaggtcatgctcttgtttgccctttggtgccttggatatatgtgaaactatagagagataagcaagggactggctcagtctgaaatactgtgatatctcagacatcttttctttggatcagtgcagcaaaccagtgctacttaacctccttcaggccactgtaaaagagtgcacacaatttacgattcctctgttgctctaaaactaccatatggtaagtttaatacatctgccttgtggtgactccaattttgtgaataaattttgttttttgtcatttatgtattaataaatttttaaaggtattatgttctagaatttcttgaaaacattcagacaaattacatgttggatggatggagtggtcatattaatttctattattattttcaaccaaccaatataatgctttcatacatttttgctttcttcatctttcactacttcccagttttatcatagctatgaaatacattttactttgaacctgtaaagggaattatccactttctgacatttatactttattttaattttttcaactgatttttgaagaaatgtttgagtgtatgtgtaggtgtgaatatgtaatgctgtactgaaaaatagcaacacagaagataaagtatggtgtctaagaaaatctctcaccttagtttatatagaaaaaaagatatttctgggtagaaaagaagatttggtgaagaacattgattatctgaagggaaatacaatttaacaggaaagcaaaattggatgtaaaagattagatctttttactaatgtaaataatttccctggtaaacaaacaaaatatatatttgaatttttatataaataaaaaaatcaactttggaaaataaactcaagaataatcataattcttgctctgtcacccaggctggagtgcagtggtgagttctcagctcattgcaacctccgcctcccaggttcaagagattctcctgcttcagcctcctgagtagctggtattacaggtgcacaccacaatgcccagttaattttggatttttagtagagatggtgttttgccatgttggccaggctgtgttgccaactcctgatctcaggtgatccacctgccttggcctcccaaagtgttgggattacaggcgtgagccagcacacctggccttgtcatggtttctaatagttagatgcatgttagctgaagtcattattctgaatgaaaatgacatatgctcttgttggatgacagatattgagggatccgaaaggatgggatcttgccataaaaggaggcttaagaagaaagggccaataggtgatgataacttcaagcagaggggaaggagaaacagactaagctttatataagcacatgaaaaaatcctaaaatcttagagcatcaatatacttgcaaataatatatacagaggaaacttattttcactatgtagcagtggaagaaagtcaccatggcagcctgaaattgtgtaaataatgagtgtctctattaaaaaacttgatttcatttttctagcttctcttcattttttgttaaaaagtttctattcaatgccataaatgtgtgggtgatcatgaaaatgacatcacacagagtcaattgttaagcatgatgtcctctagaacacatactacctaatttatcttattattcctaatgacatttagaatccaaacacgtcatctttccataatctggccactccagctgtcttactacatttagagcccagcacagtgaaagtctgagtgagaatatttgacagaacgattcattggttttcctccctcccaactaaacataaataacctttcatgagctcacatttatgtgtaaaagagaataaatcaaagacattctgcatttgattgttatgaatccatattaagtaaattatggagagaatggtattgaatgaaattgaagagcttaatgttaaaaggaatcacttagagaatgatgataaacacttggaattattcattatctgtccagatagcttgcatatcacatgcaattattttaactttattgcaaggttgttatgggattcaaaagtttgagctccaagagtctagtgtgatcctgagagtggagctgaatttttggcatcagaataagatgctttttttttttccttaatgagatatcaactagagattaagatatatggtagagagccagtcttaaggtggcaaggttagaaaaagtaaaaagtcatagaaataggacaaagacaatagcaggaagcttgaggtaaccctttcaaggatcagaaaaaaaagcttatctgagaagggggacaaaaatcaaaagaatcctcttcattattatcggctctaccatatttccttttgaaagaatggtcgattttactaaaaatatgcataggggacacaggacacctaccttttccagtagttggcgaagttgcctgcttttggcatcccgggaacacaggttttgttctggagcaacaactgtgcaaatgcaccgcccatcaggatcctgagctgagctgtacacctgccacccttctttaggactaatctgagtctgaggaaaccaaagggaaacataaaacacagactcctgttataggataaaaagagtgttggtttgtagcatttcaagtaaaacacttttttgataatttaactttgtgttttcaatctttaaagttagcagagagatattaaacaatttatataggcagtatagcttcattcagtataccctccttatcaatgtccaaaacaagatcctttcttgtcttcaggtgccatattagtaactgattttgatctcatactatttcccaatgctttttctattttgtgacattttaatgcaactttagaagcatctagtaactacttaatcacatatgactcgtctttctacataagatcttcttaacagtaaatgacaattactaatattaatatattattttctaattataattcatgtgtgatattctgaaacaaagtcctgtttcaaggaggtttcccatatattgaagccttaattattaataaagtggaaaagagatcattgacgacataggttaaaaataattagaccagcactattttgcacgaaatgcagactcttagaggacttagagtttttggcagagtctgccaaattgattttcccaaaaacttctgtacacttatcactctaccttcttagaactcaagtgtgaaggggtggtattccagttctactgtagtttttctgcaatttatgcttctagatttatcttctgtaccatccaacagaaacctttaaccaaatcggtctgtgtgcgtcgtgcaagcatgccatgttgattcatgtctttttatgtcgctcatttcatttttcctgcttggaatgcctcctttataaaccatgaatttattcagcccttgtgatttctacctgttgtgaagaaactgtctgtactattcattaggtatttaatgtatattttctagaattgtcatttgcctttcacatatctcatttcaacaattagcttatatccagctatttttttttatatatagacaaaacctcactctgtcacccaggctggagtgcaggggtgagatcacagccactgcagcctcctgggctcaagcaatcctcccacctcagccgatatctcagctcactgcaacctctgcttctcacgttcaagcgattcacctgcctcagcctcttgagtagctgggattacaggcatgtgtcaccatgtctggctaatttttgtattttcagtagagatggggtttcactatgttggccagcctggtcttgaattcctaggctcatgtgatccaaccgcctcggcctcccaaagtgccgggataacaggcatgaaccactgcaaccagcccagctattagaaatgtaaatatttcctatttgacctatcaagtagactctatcaagcacaaagataagcattattattttttatgaaatcatttttcagcaagaacatcaatagacttccaaataatgtacaccaaatttattttcataaataaatttcagtggaagaaagttaccacatgtagacttgaaattctgtaaactagaagtgtctgtattaataaacttgatggttttatttttctagcttctcctgatattccattaaaaagttcttttcattatacagatagaagctattttagtagagttggatctcgccatgctggccaggctggtctcagactcctgatctcaggtgatccgcctgcctcagcctcccaaagtgctgcgactaaagctctaagccaccgcgctgggccaggagcaaattcttaaagtaactaaagcatgaaccaggttgacttctttctccacagatttaccatagtaggtggagtcttctgtctctagaattcacagcagaagagacacaatctcccgtatactttgtcctaggttctagctcatcacataccataaaccaccacaaaggtctttttcttctgaaagctttaatgataactacttctaggtgccgataggccttccaacaacaatcatgagcaaatattggggatgctaaaaattataaactcaagaaactcatgatgataccaagtcatcatccttgatctattacgtaaaggaaatggtaccagacatatcttttgaatgtcttattttctaactcctttaaaaaaattaattcatagatgtttccaatgctgccttttatttttgggggtcagactcgttaacattctccccatcccttctttctagctcttatgcttgaatatccagttaggatggaaagatgtacttagaattatacattattcaaattagataagatcttagagattactgggttagtcttttagtattattttttaaaatgcagactacccacagaatggaaatagaaacagcttaccagagtaatttcaatgatataattaggttcaagttgagtaacagtatgcgattgatgtatctggacataagccctgcagttttagctgggcatctcctaacattggacgcaaatctaaaatatgccagaaaattgaggcttgtcactaggataaattaatctattggacaaaggatgagaggccacccaattataatattaaaatattttaacagcagtccaaacactgattattaaacctggcagcattaatattgacgtgcacttgccaagtgtttggctaactagtgtggagctcatcatgacagaactccatgtcagttgctctctggaaccagggaagtgggaaaggtgaagagggtttaatgttcatttagcatttcccctgaagtgtcagttcaataaaactaaagactccagacttgtttgtacttccaattgtcttattgtaagaatcagtgaaaagagccatgaccttctctactacagagttactttgaatgatttaaactataaaaagccagctttttgacaagaaaaaggtaactcaaaagaggaaaaaacctaatagaaaagatgagtgcttgacagtcctgtgggttttgatagagacctctgtgttggggtcagtgataaatagaagctttatgagtgtttctagtgttctcttttagagaatccatgctggcattgaaaagagaatcaaaatcaaaccaactaagatctcggatggaaggacgtatttagaagttttttggaaaagacttgctccaattttaacatataagaacaattatttaggtgtcaataaaacatgcaacaggaatagcaatcattaatggagttctattcattacctggcagttcatatgtgctattgctttcgaatattataatacacctatggactaggtggtggtattctgcccattatacagatgaggaaacagactcagagacaggaaggaacttgttcaaagtcatgcagggagtatcagccagtgagtagggagatttgtgtaaatctgccttttaggcagacctgggatttgtactgagagagtcttatttcagagatttttttttttttttgagacaggttctcgctctgttgtccaagctgaagtgtagtggggtgatctcagctcactgcaaccactgcctcctgagttcaagtgattctcccaccacagtttcctgagtagctgagactgtaggcacacacaatcacgcccagttaatttttgtatcttttttggtgatggggttttaccatgttgctcaggcctacctcgcactcctggactcaggcaatctgcccgcctcggcctcccaacagagagtgaaatttaaccaccacactacaccatcaattattttaataccctttcatacataatgattataaccttggtagcattttctgaactactgtgaagctcagtgcttagacctggagggtacatatagtttagtggtacccaaagcattaataatcacagtgattactgatgcagttctctttgaacctttcgtgttaattggaagaactaaatgaagtattgagcagtttttaatattgtaaaactcataaaatatttaagaatgctctaaataggagaattaaaattatagttttaacaattgtattacaaatctggattatttgcttataacttaattacaaagctgtgctttataaatataaagctagtatatgatagttctaaggcttcaggggctttgtaataggaaagaaggatcttgaggcttgacaagtaaaagtaaaaaataatcaaactaccttgcatttcaatagattttttgcttataaaatccctgctattgttttagtctcacttttcttgaacgaactatccttagaaatagacagtatttaaatttacttatgaggaaactggaaaccaatactcaaagaacttaaacatgttttataagtcatccattttgttaatgccatatataggacttataccagctttccccagtttttagcccagagctttttatgctcatactctttggataaatgtagatagatcatctatgtccattcaccagtaaccataaacactgctatagagaagacaggccccactgtagttgatgagaagagatgcacccaggcaggtagagggcattatccaaacagcatggaaacaagtagccattggtgcctcagaggaacagatagcagtacaggctctgcaatatatagtcagatattcctgtggaaggcacggcaatcatttatcagggtctagatggagggacaggcaaagtaagagaattctgatcctttgaacagaagaaaatcaactgatcgaatattgctagattttttgtattatcctgattttctgggtatttcataaaaaggacaaaaagggatatagctactgaaagtgttgtacaaatggaggaaataaagcctaaataaatctgtttattaaaacttacttgatttagagtggagatacctgagtgatgaaaaatccctgataaattttctgtctgaagataggcttggtcccagagagtgacatgtggtttagcatgctaatggcttcagttgtggagacaagaaaatgtgaggacaggaattagacagatgtcgacagaccacgccaaaagaagctgtgttctggaggatgttaataaagatgtcactgcatagctgttttcttgctattacttataataattcttaggactgaataagaaacgcgtattcttcactgaaggaaacctccaggctttaagaaaaaacaactataaaagcaaaaataataataataataatgaataaaaaccaaaaacattatcaaatttaggttagggtgcagtggctcaggtctataatcccaacactttgggaggctggggcaggtggatggcttgagcccaggagtttgagaccagcctgggcagcataatgagaccccctcatctctaggaaaaatacaaaaattagctggacctggtagcctatagtcccagctactcagtggggtgagatggggggccgctgaagtgggaagatggcttgagcctgggaagtcgaggctacagtgagccgagatagtgccatggcactacagcctaggtgacagagtgagactgtctgaaaataataataataataaatttaggttggtcacctctgcttatgccctttggaaatcacaatgacttagacttggggaggtccttagaagtcatatttagtcccatgtctttccacacaatggaacgtctacaaattctccttgtgtttccattagacctctgcatgaaagggatttcactgctttacaggcagccccctccactgaagaaaagcagggggcatgagccgaactcctctctctgcagttttccttctttggccctacttttgcttcaggcactcaagctagaataaatctactctcttattcatgtgaggattcttctataagaaagcaatgatcatattctctgtcaccatcaagatttgccattctgttctctcacctggcttccctccttaatttgttcagttgccctatcacgaaatgagcattacctaagagtttagggaaggaaaacagaatttggggggaaaaacagtcatatacaaatcagttaaatcagatatcttcatccaggactaaaacacattggttaattgaggttaagaagcttagaagatattgacagttcatttcaggggattctactcattttatagaactttaaattgactaactcatcaaagtagttattcatgaggagaagccagctagacctttgaaaatgtaccaaaacaaatgacatgcccacaggttccttcgaggcctcttcccaccacagcagtagggctatttgagaacagcgggtgtctgctgaatgtcctcaacttttttaattgctctttcccagggtcttcctggtgtgaagcccacagcgtgagggatttctcagaagctcagcctctaggggaagttactctgcattcaagagacgcgccagagggagcctgagccttctgagagctgaggcttcctctgctcagaaaccaatgcctccaaaggctgatgggcccagtggatagattggaaggggaataaaaaagaaagaaaacagggccaacaagaaggataaaggaatgtttcaagattctgagaaaaacaagaaggagcttattcccctaataaggagctgtatttaactacttactaataaaaacatcctggaaattttaaaacccctttcagcttttgagataatcaaatgtgtcctgtttcagaggcacctgccataaattgatttaattgccatttaatgatttaaactctatttttcctggttttctttttccaggtcatttgaaactatcattctaaaaaaggactatgatcatatttgtgtaaatctgcttttcttaaaccatcgtatttatgttaatctgtttttttaacctctgcgtattccatgaacattcagatttcaagacctgcgtgtgcgtgtgcgtgtggtatattgcaaactcatcccattcatactgtttaaagtgagaacatggagtgagaacattgatgagaagagctggtttactactttacagcaatacctagtgagccagggagctgtcaacccttccatctaagggaagagttttgctggccctccacatggaagcagcagtaagggtcccttggaattatttgagaggcagcaggaagaatcccctaagcaaaagaacctctttcactgctttgtcacatgcctaaaatgccaagaaaggaggatttttttcttctttataaatgcaaaacctttgggaatggttatgacataattgagagtatagcttttctccaattctatgaggccagggagatgagaaaacatactttaaaggatgaaggtgttggtgtgtaggagggaaagaagaagaatccagggacatggaaacaatctgagcagggtagtgagaacctagtggggcaccagggaccaagagggccaatgactggcaaagcaatggtgaaatagctttgttgagtagggaggtagtcatgtaacttggttccacacttgcctctgccattaaccaaatgggggaaatctgattggtggcttaaatatttccagttagtctccccatttgtagaataatgaggctgaattagatcagtcatatttccagctaaagtcttgagagccctaagatttctaaggagatatcttgactgagacaagcagttgattgtgtggggagataacacatggtggaggcccagtaaatgcctctcccaatcatttattatctgacttaagacctcttttatgttttgaattttcattttgttttattcaaaaatatttatttagcacatataagatttaatttgcaaaaaaaaaatctgctgctaaaaatagtatgaacataactggcttgatggtttctaagatcctttccacctttctagcattaacattttatgttcctagtctaagagatactgatgcattcattcttcaccccgggaatcttaaagtatgagcactcatttggataattagggaaatgtcatagacattgctcttctggaaagcatacctaaaataaaaaaaagaaacatccaaaaaaggttttctccattccagtgaataccatttactggtttattttcagtagccatagtgaaaccttttctacattttctgcttttgttcttcttcttattattattttcttcttcttattattttcttattattattattttttttgcaaaggggggaatcaaaagtaagaattgtctgtgtcaaaacatatacagacatacagcaatgctttatatttttcaactaacaatttttcaatcagtaagtaaagatatttaatttacttgtaagataactagaaatcctaagagaatcatgtataattttggaaatttcattctcatcagtcaacaataaaaaaaaaccaagccaatgtctatatacacaaaaaatatacatgtcagaatcaaggtgcaaagtttgaaatataactcattcattagtacctcagtttacattcattatcctgcaagagttaattcaacaatgatgttgttgaaatctggtacttggacattgaaaaaaaaattggctcagtaaatattagataatataagtttatgttttgtaattgtttattgatgtctatctcttgctttctttataactccaaatctcttttacatccttcctgccaggccacttcatgcaggtagggaagaggatctcagcaatggaggctctggggttccataagtaacctaagggaaatgaaaatgtaaaagcaggtcaaagtgtggcttgtatgtgctctgctggtgccttaagcactgggagaatctggaaaattatttaactttttggtcagactatactcagttgattaacattggttgatagattattattagtaacagcaaataacacttggaaatggagggctacttttctttccatatctgactttttctgatccactggagtaacccacatgaaagtgaaaacccctagttttgcttctgtaccttttatttcagggcagaggaattattttctaagaaattccttttatttgaatttgtaaatttctatttcaaaaaacaatagttttcatttttctttgaaatatcaaacatgttgctcactgaaccttgcttcaaactatcaggaaatactttgttagaaagtagggaggattaaaaagccattaattttagatgaatgaagattatacaagacagtcttgtgataggaagtcttcataaaatattaaaaatacaggaagatgtttttatcaagtaagttttctattgctcatgtttcttagctttcttaaaggaattttgggcaggccttaaattggcgagttttttcattcatttatgcttaaaagatgttagtttctttgagtgaattcattgcaaatagtcacaggcattgcattccaaggaagaatctgctgtagcagaactagatttgacagaatatactttgtagcttactttgtgggaaaaattatgaagatttttacagatattaaaataagtaaaagaataagaaacaaaacatatatatatatatatttttaagaattgcccaagcttccaagtaatatagttaaagcttttcacccttaagaatttaatgactctggtattctctttcatagctcatttctcaagcagtccatttttggggtataactataaagtgtttataaataaatatgatgaaagttaccacatagttactacatttttgaagctgacctgtaaaggcagaagcaaaatcttagcctttgcaatttacaaaacaaagcccactaaatgcacttacttctcaagatggccaaacccaccgcagtaacttactaaggtatccggagtcgacagcctcgtggtgttcagtcccaccaaggatgggagagtttgggacatccagtttgagatcattgccatggtactaagcacagcgccaagcttcagcagtggaggactcattgctgtggagctaatgagttttcatagtgactgattaagatcccggtgccgggctggcagcgggaggcgtgactgcagcgcgccacatctacagcatgaaaagagatcaacttccccagctctaatcacccaggaaagcttcggaacctccttcccccatcctcgtgggaagtgccctgcccttctttttcctcccttaccagacattttgctggatcatcaaacaaaatattcttgataggcttggttggtaattatcagagagcagaggttggagggaggcggaaacttgagctttcccagctccactttagttagttaccatcaacagaatccatttcctctggggtttgtgtaagtataatcagctactctttatctttcattaaaaaaaaaaaatacacctttaaatggaggtctgccaaagtgcacatttcaaacaccaaacttaatatctacagatttctctgggcaaggacagagtgcttttaggaagaacatgaaaataaagtctgcaaataattttccagatgatcatattgagagtaggagataatttttttttttagaaagtaacctaaaattagcatcattgctttaaaaatatagtcaaagattaatagctactgcttgtggcaaacattacctttaggcatcttacacctgaacagacagaaaagagaaaagacagccttgcagaaaaacttctgttacagaaattttatatgtgtttccagttttgcttttgagaatgaaggctttgcttcgtaggtgttcagtcacacaggaaactcagttaactctattttcagtttgtgaggaatgacggactgatatggaaagtctgtatcttgagagaacatgtgatttagtataaagggcacaggacttggactcaggaagtctgggatctagtatttgttctcctctagttagccatatgactggccggtgacaagattccttggcttcagttttttctacaatataaggatgttggaaaatatgctctccaaggtcccttccagctctcaaattcaatgatctgtttattagattacattagcaagtgtggtatatagaatccagggtttatgggtaactttattatattgttttcataaatactataaattttccacatccaaatctcaggttccaaatgaaagaaatcagaggtctttgtcttatccaatatatgtgttttaaagtaaaaatataaagagaagacacaaaacaaaatatggatgaatgaaaattaaatgaaaagaaattggttacaaaaaggaaaagtattgttttgatttcttaggagaattctggacttgtttgtatttggaatcttcagccaaagatatatatttttcttaaatagttttggcaggagaaataaataaaatgtccttaataaaactgaaagagatacatatttatagtgtgtgtatattttactttcaaaaacagctttaaactggggtggatgctaaaagactcctcaaatcttccttgcaactattagcttagaatccaggccatttttttttttcaaaatatatccaaatgactttaatcaactcttattttttaaccacagtgcccacaaaaccaaatattattacttttctattctttcaaaaatcatgccatatgaaaaaccaataaaggcacaatattttatgtattaaacttagcagaaagccctgtgaaattttacattagtattacaatgtgttaatgacaaaaagcaaagtggatttacaaatctaatgttgaaaaatacacctggaactctatcttactttaataaagaaggggggtgtcttttcaagagcttaatttccaaaattgaaagaaaatatacatataattactagataatttaagaaatgaggtggcagatggtaattatacttattattgagctatcagcctacaaaatagtagcatttttagaagaatataagattgaatgtcaggggaaaacagtgctctgatttgcaaattataaagaaaggaagaaatagagaaaaacaatacaaatggaatgcttcttgtaattttccagagatgcaaattactacactaaagaattgaagtagaacaatggtaaaagtttatgattcggcgatgtttatgaacaacatagaagctaaactgtgttgtttttagaacaggtttaaatgatacacattgaagtagaaaagctcaaattacaataattattagttgtgggaaattaaaacagctgcaatttgcaaagagctaaatagtttgcagtactctcatagtctactgaagtgatatccatttgaaaagttgagtcctagtttgtaagtgggagaaaggattagtctattgagaagtagcggactgtgtttagggcaagcaacccagtagttgcagaagttccacaagcatagtgtgaatggtaatgatattaccactggcaatgagatgaagctggaaatgctggctgtgaccagctcagggcttcagggtcacccaaaagtgtttggactttatcttctatgtaattcaagagtttaaagcaaagcagtaagatcattagttttatgttgtgaatcattgcttagtcatttttatgatgcaggataggcaggcaggggctgcagagagtgcaaagcatatcagagacaagaaggtcacttagaggtatattctcacggtttgggcaagagatgatgaggtcctgaaataataaactgtcagtgaggttcaaaaggatgaattccataaaggtctgcacaacaattggcagtccttagtgactgaataaatgtgacgcagtggaaattacctgggagaacgtttagtttgggggtttggatgatgagcgtcaatcatcagaataagatacacaggtagaagcataactttatgaagaagatagaatttattgtcagctgatatgcattacctgtagtacagagggtcactggatgataatgtgccccacacttagagttcagaaaagaattaatttccctaggctgcaacaacttaatggactagtgagaataatgtgtcctacatgtatgaaaaaaatggtcaacgtaaaaatgcagttttaaaactaccacaattttcatttattcaattcatggtaaactataaacttaattacttatacagtccttcaaaataacaaaccaaaatctatcactagtaaatagtgaaatattactaaatctaataatctcacaaaaaatgtgacctgactacacacttattttctttgtggaatttcatagtggatcaataactatataacctacaattgtgcattattgctcatggaatgctgaaagctattgattaatatatttattcattagattttttatagtagcctgtcctttttattacccagagagtatatttcatgatagacttatatagtaaataataaataagcaaataaatattgagtgagaatgactcataggtaatttatataatattagcatgttctgtcattagaattttatttttttcttttatttgtagaacaaaagttaaatgttgttttaatgaccctacacagacatataatcatatatatttcctagtttgggactgtatgtatggtagatgtgggaaggtttctagaagacacaacctaggtagatatgaaaaatcaaatacatgaaaaaaacctgatgaccacataaaatatggtagaaaataaacagttaatgaggtaattgtgacctaaaagtttgactttaggtaaaatgagaagagacttagattgcttgctaaacagtagaagctttaagaagaaatagtgtactcatactttatttttattatttaaaacaaaatttaaatttgtaaatggcttcaggcagaggggaaagtggcttattagatatagttgtaaaggtacaaatacagggctgaagaaattattgaagaaggaggaggagaagaaaaaaagagataagaaggaggacagcaattgggtagaacatcgaaaaatgaactgtattgactgattaaaccagagtgacctctagaaaaaaacagtgggctcttgttagcaagttaagtaggaaaaataggaagagtaacataaaatagaagaaggtggaagacagagtacttgtgttgaaatcacttggggaatgctggataccctggatggggtgtggtttgagagtgaccaggtacataaaccgctctccaccctctgtggcaccttaaaagcagtttagtggatagtcctccagattcttccacttactagaaagataccattgactaagtaagtctctcagtctccattttattatctgtaaaatgaagatagaagcaccaatgtgaaatggttatttgagagactgaatgagatgacatattttgaaagtgtctatagtatgtcaaatgcaaaataaatggcaaccctatttttgacaagaaataccacgatttgagccagccaaaaggaacagaccagctgaaggaacaatcaggcctagagaaggtggaaagttttgcagctttgcaaaggggtagctgagtgcagcttggagtatatgctgtcttgcaattcagtcaccttgggtgaagagaataatacaactttgctggatgacaccatcagtctgtggctctggggctaatagtccaattcaaagtagaggaaagggactgattgctatttttgcttccctcttcattgaaaagtcgaggtaactactagaaaacttccataaggtcccattaccatatctgcttacttcctcacctgtgcccacatagtgtaccttccttttggttgccatggataaattgattgtgttcctagataaggcagagctctcctctgtgcaataaatcagttgttttggacaatcatgcataagaattacttgcaagcctgttaagacccaaatttccaggtctcacctgagtctgatttagctttaggacaggacaaaatagtttgcttttctaacaagctcccagatgatgctgatgctgcaattcttggcccaccctttgagtagacagccctaggttatatctctctcacctactcaaagacaactcttatttcctctttttccaacgtcgataaattttccctctttagcagatcattcccagcatcataaataccaccatacttttcctactttaaatgcaaacaaacaaactttcttgatcttattttctctccaggaattccaccatttctcactctccctttacagcataccctctgaaagaattgtttatacttaccatcttcaatttctctcttcctaattgcatttttgtttacacttctccactctgctgacactgctttcatcaggctaccagttacccctagattgctaatctagcagtcaattctcagtccccaactttcttaacctatgggcagcattcatgtgaatttactttctcctttttgaaatagttttttcacttggcttccaggatgccacactcactagtcttcctccaattttatgacctctctttcttagtgtcatttgctgattcttcctcatctatatgctaatgattcccaaattcattttttcccagcagacctctcctatcaattcagaactgcatatccaattatctacttgacatctccacttcagtgtttaacagacatcttaaattgagcacattgaaaaagtgagatcctgttatggctccccaaccccagaaaagaaagcaaaacaaaaatacaccaaacaaataaacaacaacaaaaatacacatgcagccattcctgcaatcttcccatttcagttaactggcaacactctagttaagttgctcaggccaaaaagtcaagtttcaatcttaatgtcttttcctccacatctcttatcaattcagtcagctagtgtctactctcaaaatatatcaacattcaagtattttgtaccatcccagctgccactgtgctgcttcaagcctccattgtcttttatctggattgttacaaaagtcacgagttattgactttgtatcacttgttactttgtaccatttgttactgctgcacaccaacattatcttcttaaaatataaatcaaattatgttattccagtgcctagattcccatctttctcatggtgaaggtcaaaatatttagcttgcactataaagttctacataatctggcctcctcttatcactctgatttcatttctttcagctctcccctttgttaactcctctggaggcactctggccccctggctgtttctcagagatgcaaggcaatctttcaccttagggactttgcacttgcccttctcttgtggaaattacaatctctcaatatcttctcacttctttttctccttcctcccaagatcatctctcataagatcttttctggccacactatctaaaatgtctactcttgtcacctggttgctttatattgtcttttgctgctttactttttttctccttagaactaggtagcatgctatatattatatttatacatcttgcttattatgttttctccactagaaatcaagctccatgagggagaaatgattcctggtttctttactggggtattcttagcctagaagagtgtttagcacacagtagtttcacaataaatatttatgagataaatggataaatgaatatgttactatttaatttctggcctgctctcagattaaaaaggaaaccatttttagtgtgaatatacagtacagcttattcttgcaaaacaaaccagtacaatgtattccagtattgtgttttgcatgtatgtttttatgtgtgcatgatggacctatacgtgggtaatggatagtgaaaagtattgaaacattatgcttatagttacatgtattttttccttccatttttcacatgtagaatgcaagcacttttggtctaagccaagaagtactaactccaactttgattctgtcttctattgataagcttcacgggtcactggaaccctacataaatatggaagcaatcttttcttcttcttgcctttggctagccaaatttttctctaatagcataggggtggcagaagggacgtatggtatgtagagaatatttttaaaaaaccatttcactatctatatgtatatcaagtatcatgttgtacaccctcaataaatatgataaaatttaaaaagaaaagacagatttaaaaaaaaatggtttagagaagatagagatctgagtctcctttcacccaaatctccttcaatttggcccttggcaaccaattagggaccatttgtaggtcctagaatcagtgctttgccatttttgccttgaggtttcaatattgtcttaaaagtactcactaatgaaagaatgaatttagaatgaaaaacatttgcaaagttctttaaaggaaggatttctgtcttctcatctttgccttcatctgtgaagctgactgatgctctataagcccgggggatcctccgttggcagctgttgttgctacttcaaaggagaaaaaatggatgtgtgggagagaaatatattcagggcaaacatttttttttctctttctactcaaaattgaagaagtgggaaaatataaatccaggattagtccagaaataaaaacgaagaatgcagagtggtgtgacagaaaccttcagcttagtcactaccttgctttgggtcttaggttcttcaaataggaaataaagatattaaacaaaatttcctatctagcccctttcatgatatagtgccactcttaagagctcagtctttatccctgcagtctcacgtgtaccctttcactccctgttctggcactagtagatgactagccatgtgacctcccagagctgtggtgttctcatgtgtaaattggggatgataagagatactctttggtatttgtgaggataaaataaactgctacatagaaagccctgttatagggcctggaacatgatcagtgctcaatcaatgtttgccatcactatgcaaaagaaatgtatgcatcttctacccatcttcatggaagaaagcataagcacaaatgttagtgacaagcgaagttcatcaaactttggagtaaattaacaatataaaatttatctttagagtttaaatattcatctttctaatatggtttgttcatatggattgacttcaaacattctagaaagtatataaaatgtgcctgtcctatgttttattgagaagcttccttatttaagcctgtcagccaggcactattctaagaactttacatgtatgaagtcgtttaatcctcagacaaacccgatgaggtagtattgctatcgtaaccagtttatagttaaggaacagagacactgagaggtgaaatatgttcgctgaagtcacacagctaataaatgacagggccagtatatgaacccccatagtcagatcccagatagtgtgttgttagttatgctatctcactgtgtctcatacacacactcacctcataggtatgcaaaaaaatagccaatattgatttcaaatttagtctttttaaaacaattagaattatgtgggtgaagcattataggttagttatttgcatgctttatcagtgagtgctaaaagctaagcacaaaaattaaaagcaacatgtcttcacttattgagtttatctttgaatgtgatggagcaaagctctcaccagggaggcattgacactcaggtaagggcttggtccccctgctttattttcactgcaatctattttcagacttttctaattcacccaactcactagggcagactgaagtgttaaattattgccaaaagcttttctggaagaaattgtttagaaagataaattttaaggagattgggaaattgcctggtgatcagaaaggagactgtttcagtggttgtgtgaaagaacaaaattggatcttcaaatgtgcaattttctgaaaagttgttatgagttgtttcataaagcttatctccctcatggcatataaaatgtatgtttaacaggtaccaaaaatctggtggtagtaaacaaccccaaacatcaaagtatgaaagaagattacatctgtagtctgctttttaacaaattcatgcaaataggagatctgcagagtagggttttatgtagcagcatagttacactgtttgtcatcattgtcctctcatcaatatgtgtagtaaaggttattttgtgttttgaaagctctaggcagacaaatacggttaaatataaacctctaaagatctggtgttgaaataagtcaggcactatttatcactgaaagcatcctaagagttatacagttttatgagaggttgacggaaacagttaagtctggttcattaaaataaccaccacatagatgaagccatataaaccctttacttcattaaattgcgctttttggcttcaatgcaattaaacacttttaaccttataaaaactgtttcaggaggacataagtaactcaattgaaaaacaactccctttgcaaatactcatctgaaaagagaccagtgacttacgtctgaacatagcaatagataagtaaaggaaaaaaatgttgataaaggttgtctcttgttattgaaatcaaatagctgatttttttctgctacttaatatttttttgttctctccacattttccagcttaattatgtattattttctgttgtcagaaaaacataaacagaagtatgttatgtctctctcactgacctttaaaggcactggtctattaaacatttatcaagtgcattctttggggcaggaactgtactattctgaaaatttaagattaatatgatacagccttctgagtatttcatcaaactgggattgtaacagaatacaagtgattatgtatattggattcaaatagttccacacttgtaagtacctatagggatataatggaggagaaaaagaagagggaattagtaccacatagtgtaatggtcaggaaagaccacagtggaaaagataatgcttgagttagttttataaattcagatctaaatttctagttcactcagagaaactgacagtaaaatttactatgggccctgaacacaagataaaatgtaagtcatagggatcttggtcctatactccaaaagacatttatgtatgttagctctttctttgtcaatgtacatctgtttccccagtactttacattttcatctctcttttcattaataaaataaagtagtgatatttacctagaacataatatagggctactgaatgtaaagagactgtgaaaaggaagtaactgttgtcaggaaaacagtattttccttgggaagtataacagacacatagaaatatctgagttcttggagaaccttgcattatcaagaaaatagattcaaaattacaaacaaacattattcaacaagtaatttggattataaatttacacataatgagtcataatgtacagagctaaaactgtaaatctagtgtagaggcttcttatcaggtctctgcaaagagacatatatacattatataaacattgtaacgtgaggagtgttaatatatttaccatactgaaaatggatcagctttgcaaagcattccacccgctccccatgctctcctttcccccctctcctttccccttctctcttcctgccttccttctcttacattcttactttcatctgtctttccttcttttctacctctttgtctccttttcttccttccatattttctcctttcttctctttcactttcaccaaactttattgagtcctttctaggtgttctgcactgaagtaggatttaagtatggtttccaagaattccccaggtaattttgatgtgctctcatttttaaccattgcctaggccgtatggctgcaatttaagcacagatcattgtaatattttgcacttcatatttggaacatttgatttacctctccactcattcaacactgttttaaaacaaaacaaaacaacttttttcttatctgaacattgaaaatgcatgtgtaggtcacaatttacattttattgcaatccataaggttttaaagaagttattgatcttaaaactggaaactcctcataactggtatttcataatcatagtatattattcatgtgaacctcattaatagctttttcttacaggactggttaataaatatgtcaatgataaaaaataaattttctctcatatattttccctttcaataatatgtgtactaatatctattaaagtatccatataagtgagttaatatttttctaccaaaaatatatgtagaattatttgaggagcaaggtctgtttcacagtgaaacatgaaacctgcatttatgcattcaggaaggatttattgatcatcctctatatgctagacactaaatgctagagatcaggaactaatgcaattaactctgactcaagatctcccattctagtgggatactgacaggaacaagaaagaaatatagctgtaagtataatttcaatataatgggacccataatgtgtacaatgtgcaatgggtcattgatatggtttggatttgtgtccccacccaaatctcgtatcaaattgtaattctcaatgttggaggaggggcctggtgggaggtgattgaatcatgaggtgaatttcccccttgctgttcttgtgattgtgagttagttctcacgagatatggttgtttaaaagcatgtagcacctccctcttcactctcttcctcctgtgccagccatgtaagatgtgcctgctttccctctgccttctactataattgtaagttctctgaggcctccccagccatgcttcctgtacagcctgaagaactgtgagtcaattaaacctcttttctttataaattacccagtctcaggtagttctttatagcaatgtggaacagactaatacagtcattaactgttagtgattaattccatttgggtgggatagaggaggcttcagagggatagtggatttccatggcttcaataaatttcccaagaaaatcaggaaggaaaggccatttcaacactggtgacagcatgtgaaaactcatttctgaagtgtgaaagatcccatgttatttaggagatctgagtagcttgcagtgggggaagtgaaaaatgcatgatagggggaaggaagagaggaaatagagttggaaaggtagcaggaaaaagaggtagcagaaacatgtagctctccaaagagaagattaaacattgctaccactatgtctttatggagtttcaggaagaaactgatgataccaaaccagtttgttatttagaggaatatcattcagaaaagatgcaataaatattagggagtgggcgaggagtgagaatgccagctgagagagtagttaggcggccatttcagcgtcagcataagaaataacagaaagactggggaagaataagacatgggctaggcacattacacaggattttgtgaataattagatgcaaagacaagagagagaaacaagacaaaagcagcctctagatttcacaaaatacaatacaagttaaatgtctcttatttgaaatgcttggggacagaagtgttttggattttgaaatatttgcattatacttactgattgagcatttctaatccaaaaatccaaaatccaaaatgctccagtgatcatttcctttgagtgtcatgttggtattcaaaatgttttggattttggagcatttcagatgtagattttcagattaggaaaattcaacctatataacagaaagtgtttaagaattgtctaggccagtgcttcttaaatgttaaggtgcaaatgaatcacttgaggatcttgtgaaaatgtagattttgattcagaagttgggaatagagtgctcgcttgaacagcacatatactaacatggaaatgatacagggaaggttagtgtggcccctgcccaagaaattggggatacagtctgagattttatatttttaacaagctcccagaagatgcagaaggagctggtaaacaaaacactttttgagtagaaggagccatggaagccagctcagagactgtggaattaagtgaagtgctaatgtgtgtagacaataaggaggcacaaccaaagtggggttgcgggaaaggccagctatgtaagagaagtgtgagtgaggattgcccagaggcacacatgcttcttatcaagaaagggggtccagagttcttgtcatccagagttaattgttaacagaaaacatttaaaagtaatccactttaaataggtaccaatatttcttagaagtaaagaaaagctgtatttaaaaatttatcttgaactaaaaaaataaaaataatcttatccttgttgtgaggatgtatttgcaactgcgtgttaactcagcatgaataacagtcttaattcatatatgtgtgtgtttatgcaattattttaacaatctcattatttagtttcattccacaatcatgaagagatatgtttttgcaaaactcttcaaggaattccataattttttcagaccctcttttattcttttgatatccatatcattgtcttttgaggagtccgccccataaattttctcttcaatcgttaaagaatgtataccttccagctactgtttagtaatccctttgtatttggtcagaccagttctctcataacacttccatcaacttcatgaaatcatgtatgtgtcttttacatgatattaacttccatcatatttacaataaatagcattaggtagtcttaatatccaaaaatcagtggctcaagaaggattccactgttaggcaataagggatactttagtgggattgagaggtaattcattaaataagtggcttggaaaacacatacttttgataactttaactcagggttgtcaagaggcttaaacataatagccagtcacccatatgctctgactttttgatataggtagaaaagacagagaaggatcatgctttcacataattcactcattttagggacggatcctactaactacatgcagaagagttaatgcattgtgttctcagcagctacagaaatctgaaatgaaatagtttgatttgattatatttttttttgagacaaattcttgctgtgttgcccaggctggtgtgcagtggtgcgatctcggctcactgcaacctctgcttcccgggttcaagcgattctcctgccttggccacccgagtagctgggactacaggcacccaccacagcacctggacaatttttgtatttttagtagagacagggtttcactatgttagccaggctggtatggaactcctgacctcaagtgatttggccgccccggcctcccaaagtgctgggattacaggcatgagccaccgtgcccggagatttgattatacttttgtctgtcagaaagaagatgttcagaagataactgcatcactggctgctgcctagacattaccagtgtttgtagtatctacgttactactgtctcagtgaggcccaagtgtccaggaaacaccatagaaggttcagggaaaggggaaagcctgaatagttgctgattggcagctgaacaaagataaagctattcccatatgacagtggattggaaggtcacgataatggaattctagtcttactgtccatgtgaagttagcagtatggcatgccttagtttcttttgaagcttcaacattctctgactctatgcattgtgttaagagcatgggctttgtagtcatgtagacctgggttggaatgccaggtttgtcacttactgtgtgatcctgtgtaaattaattatttttctgaacttcattttactaatcttcaaattagagattataatatctactgatgaagcccacctgacaaggtacaccaaaggcatacttatagttcaacgaagttagatttattaacttgttgtatgaagggagattgcacagcagaagcatggagcatccaatcaggcaaaggaagaaacagggttaaaaataggattgggggaaaatggtgtttaggcatacttaaataaagaagaatcgtgatagtgctaaaaatgagcaatgctcaaagtaaagagattaacatcaggccagagttaagaagtggactctggattctgtttccttggaaactccaaagttaagacacatgttgaatattgtatctgaaaaacccttatctgaaattttgcacctgggttgaaaattgaggctgtttcttggtgtcagtgactcaaatcttccaggcaagtgtaggttgttccatttttactgatctgatttcaaacggcagagtttctaatagtctgtgattttagagaacaaagtgtctcagtgttacatcctttggtaaagtagcaaaagcagtattgagaggttgacctcataggcttgtacaaataaaatgaagcaatgtacatgaagtactgagcacagtgcttatcttataagcaattgttactcttactattattgtttagctgtactttcacaaataaatataccataataagacaggatgctgacttaaaatgactaaactttagttactgaaaagcacaattctgaaaacttagctagccaataaatggaggaattcattcttatgaccttagataccccatgctttcaagaggagtctaggtgcagcacaatcacctgttgcctttgataatactgatttcctgatcccacctcaccagaaatgtgattcaataaacagacttgcagagaaatatgtatttgcacttttcaaaagctcctgattttgatatgcaaccaaatttcagaaacactcatataaccaaatgaccatgaggaagcatttcaatacataaactattcccaaatgatcagaagtaaaagtttagaacattaaaaataggcataaatatgatcttgtacagatttcactcagtgttgtaatgccctttgaaaatctctgatacattgatttttcaagttgaataccttcagtattggtaaaaataaatcctatgtaattagtttttttttttttttgagacggagtgttgctctgtcagctcattgtaacctccgcctcccatgttgaagcaattctcatgtatcagcctcccaagtagctgagattacaggcatgagccatcacacttggttaacttttgtattttttagtagatacagggtttcaccatgtgggccgtgctggtctcgaactggactcaagcgatccacctgccttggatccgcctgccttcccctcccaaagtgctgggattataggcataagccagtgtgcctggccagtagctgcttttgatattggatatttccaatcatgaataagtccttgctatactcatactccattcattgtctgagttctgctttctgctgcaccagccaagatttacttctttctgctacataacagcccttcaaatatcaagctacttcaacttgtatgttttagagaagaatacagcccagatttttgaccatttctcttatgatatgctttcagagcttcccccttcctggttattctcatctgcacacattcttgctggttaatcttactagactcagtacagaatcatatactctgaaacattgtaggtttgtgtgatgagcctagatcaggaaagtaaggacgcttattcgtaaaaatatcaatatattttcccttatagaattaggaaaattatcacaatttaaatatattatttttttcatgaagaattgtggttatataactgacacaaagaaaatatttttattctaagccaacaaacgctgtctgctaaagtgaagttccattgcagaagacatggttatttttcaattatgataatatatatctcagtgataaatcaaattaaaatttcctcatcactgcacataatgatttaagatatattcttaaatctcattaaagattcactatccctaactgctattggctcccagacaattgtctcataggatggatctctgagcaacttgatgcttcagaaatgggctgagaccccatggggaaaacagcttagagggcgccagtgcctcttctcttctgcttcagggctttgaactttagtttcgaatttagcccactcacccttctcctaactctcctaacaacttcagttgttactgaattagctcatatgcaattggttaattggggagtgatgtcagtataatgtgaatttgttctggttcatatcctttttttttttccaaaatctttaatattttatacaaaaaataacaagcaaagtgtatgatcatagctgaaagcagcaagctgcagttacgtagtcctttacacaatgataatttgcctacagttattttcttgaattgatttggacatgtgttgcctgtgttactccctaattgtgccttttctcttgtctctgtagctcagctacctcaatctatccttacatccatttttgtcaagtaatcttcaacttgaaagttaagaccctaaacagtatttactgaagtatttttatttattagcaatataaaattattttagctgtgttagtatgtaacacaattactgttttttgttaattctctaacaaaattgtataggtttgaggggtatgccataacccttcttgtttataatgcatgattttggaaagcatgaggttttcttgaggaatgtgtattttgcattttattagcaccatgatcaggagtctcccaaccagaacagatcaagagacagtgtggttgagggggttttgtgaggctggggtcctctgaacttcactcatctcagtggctgtaaatcctttacctcaaacacttgtggtcaacttcaataccagtgccaatatgtctcactgaatgtgaaaagttaatggctgaaaagatatttttatctccctgttcaaggcttttaagacatgccacactaccacaaacagaggcccataaaaacagtttctcaggattctcccatttctgccctcatcttaatgacttctagcccattccatttggttttatctattaggttggtgcaaaggtaatttgctttagcttaactccttggcttcaatttcttggctcagaccttcaaagttgattagtatttctgcctcctccttatgtagaattcactttggtttccctcagccatttgtaccatggactttctgagtggtttcttgcttattctgtcttccctgctccagttttgagcattatggagccccctgcaccagggtgatttctcagcagtgctcctaattggaacagccctggccaatccttaaaatgaagttgatttagtaagattgtcatgagagaatataatggcatttttgatcctgcgggcttactttcaaagtcactttaccttccaataaggctaagccttttcaatctttataactgcaaaagcaatctagctattagcacaaacccagagtagaattcaatctacactgcagacccctaggcatttacttctccttttataatgtttttaaatgctgtttcatattctggtagcttctccaagtatgtgacattactccacatgtgggaggatattggaatagaaagtaaagacacattgattccttcaaatcagcagcaggtcattcagcagcgctttgtgccaatgtaccatataaccacttcctactctacaatcattagtatctatcctagcatatccaatagccccagaaagtcacagcctggacaagtcctgggagacactggctgtagtgctatcattcaaagtctggtaatgcccacaccggctcagagttggcaaattcaaggactacgaggtcaaaattatgtaactataaaattatataacatttaactctactagatttgctttaaaaaggaaaataaagaatttgtattaacatcttaatgaatttacacagcatagctatttggttgagtgtttattttatttgatcagaatcattcttaaggagaaagttaggccagtgattttcattatatgcaacaaagctgtttgcctttccaaatgcatacagaagagaaaacagcaatcatatttcatcagctgaaggaatctatcagtatgtagagcactaatgaccattcatttgtatatttaaaatacagccagatgaaataaaatgtctcgaatttccagaaagttgttttcttcagtcaaatgtatttaaggaaacactatgtttagtaatataaataaatataattatttgtacattaaaatgtaattgctgtattggaattagaagatcactacttttttattttagttgaatcattttgaataaaatgtatttttgagttggtattaaatcaaataaaactgctttaaatatatccattctattttaattttaccaaaataaaatatcttcaatattattgttcaaacactgcaatttatgtattgaatcaatagatgataaaatcctaaaaatacataatgccacatctttttttagcttcagtgattagtaccttaatttaaatgcttgcttcataaaagcgtaagtagtttgttaaatgtcaaggtatattaggaatgtaatgtgcattttaaaatctggttaatgttaatttaaaaaatagctatgaaagaacatagaaaattaaataacatttaatagtacttaatataaacacgataaattacttaaataagcattcatctgctcatattactgtttttacatatgcattctacataaaaatttttgcaatttaggtaataatttaaatgcaatatgtaacatcacttatcctttattcaaatatttgcaggtttttaaaatacagatagtaagtatgactcggtaatggaatgtaacatctctaatttcaagttttatgtgtgtgtgatttaaaatatttattggttttactacatgttgtgcctgagagaagagcagaaatattatattttaatggagtcagaggatacagccattatttaaaccccaaacacttggctcattgctgacatggacagtagtgacttactggtctgcacctttatgatgcagtcaatggggcagcattatgatactacatttaaacaagcacattactttacaacctcttacaatcagttatattgcctatacgttaaataggctttggtggtcaatttgcattgctatacttattttaatgatgagtaattggtgtggccaaggaaggctaaaaacatgaccattgttgcacagcaatgtaacaggaaaagttgaacctctgatttacttatcaaatctggagataatctttactagtaattctatcctttgtgatcttctaagactgaagcattttgctataagaacctcatcactaacataaatattatagactgcgttttcaatattacagtggtgtcatgttcttagtatcttaattgttcttaatgttcttaatatggagaactcctgaaggattgttaccttccttgtcagccacacaatgtttataaagtcaatctagactagaatactattccaaagtcaatctagactagaatactataccacaaaccagttgttttcctattagacagttttctgttttctgaggcagggtgaatttcatgattatttatcccattaggtcagaataactcagcgatgaagaccttgtactccacgattagccatacctagatgtgaattctgcctctactacccaacaactgtttgactcaaagaaagttatttaatttataaatatttcatttacctatgtctataacaggaacaaataatagtttttgcttcataaagtcagcatgagggttatgctatggtttggctatgtccccatccaaatctcatcttgaattgtaattcccataatccctatgtgtcgtgggagggacctggtgtgaggaaattgaatcatggggcagttcctctatgccattctcatactagtaagttctcacaagatctgatgattttataaggggctcccaatttgcccagctctcattcttctctctcctgacaccttgtgaagaaggatgtgtttgcttccccttccaccacgactgtaagtttcctgaggcctccccagccctgcagaactgtgagtcagttaaatctctttcctttataaataatccagtctcgggtatgtcttatagcagtgtgagaatggactaatacaataaattggtaccactgagagtggggtgttgctgtaaagatactcaaaatgtggaagcaactttggaattgggtaacagccagaagttggaacagttggagggctcagaagaagatatgaacacgtagagaagtttggaactttccagagacttgttgaatggctttgacccaaatgcagatagtgatatgaacaatgaagtccaggctgaggtggtctcagatggaaataaggaacttgttagatactgtagtaaaagtcactcttgctgtgcaaagagactggtggcattttgccccagccctaaagatctgtggaatttttaacttgagaaagataatttatggtagaaaaaatttctaagcagcaaagcattgaagaggaagcagaacatacaaatttggaaaatttgcagactgtcaatgtgataaaaaagaaaaccccattttctagagagaaattcaagccagctgcagaaatttacataagtaatgaggaaccagatgttaatcaccaagacaatggggaaaatgtctccaaggcatgttatggtggctcttcccatcacaagcctggaggcctaagagagaaaggtttcatgggctgggcccaggcttccccttctgtatgcagccttgggacaaggttccctctatcccagctgcttcagctccaaccatggctaaaaggggccaatgtgcagctcaggctgttgcttcagagggtgcaagccccaagccttggtggtttacatgtggtattgggcctgtgtgtgcacagaagtcaagaactgaggtttgggaacccctacctggatttcagaggatgtatggaaacacctggatatccaggcagaagtttgctgcaggggcggtaccctcatggggaaacactgctgggacactgtggaaggaaaatgtggggtcagagccccacacagagttcccactggagcactacctgttggacctgtaagaagatggtcaccatcctccagaccccagaatggtagatccaccaacagcttttactgtgcacctgggaaaactgcaggcactcatgccagcccatgaaaacaggctgaagtggggctgtaccctgcaaagccacaagagcagagctacccaaggctctgggagcccacctcttacattagtgtcccctggatgtgaaacatgcagtcaaaggtgatcattttggaactttctggtttaatgactgcctttttggccaatttctcccttttggaatgagagtatttacccaatgcctgtacctccattttatctaggaagtaactaatatgcttttgattttacaggctcatgggtggaaaggacttaccttgcctcagatgagactttagacttggacttttgggttaatgttggaatgagttgagatttgggggaaccattgggaaggcatgattgtgttatgaaatgtgagtacatgaaatttgggagggagcaggggcagaacgatatgttatggctgtgtcgtcacccaaatctcaccttgaattgtaactttcataatctccacatgtcatgggagggacccagtgggaggtaattgaatcatgggggcagttttccccatgctattctcattatagtgagtgagttctcacgatatctgatggttttgtaaccatctggtgttttctctctcttgctgccgtgtgaagaaggacatgtttgcttccccttctgccatgactgtaagtttcctgaggcctccccagctttgcagaagtgtgagtcaattaaacttcttttctttctaaattacccagtctcgagcagttctttatggcagcatgagaacagactaatacaggtaattatgaaataattgaccagctaaaatgcttagtgtaatgccagaaatatattaatgcactattcaaaaatattagctgttaacaatattaacattcccatcatatttatttgttaaatagtcccaatagatagcatgtagttgatggaaaattgtgaaaatttacttggtaattacaaaataattgcttcaccttccccctataatgtggatatatctctttgtagctgaaaaaaaaatctctgagacatcagtagctcaagggatgttgttcattaccttaaaatttttccataattcatcaataacatcatgctcacctttctccctcataatgttcccagacagttttagctacagtgcatggcaatgacttctggtgtcatatttttccccacagctatcactgggactagtggatataaaagtatccaccttgaattagctaaagacaacacagttgccttgcagtaccagtatttgagattcctaacttttcataacaccttttcaatctttgtctagctttccaactgcttgttctacttcttcctcatacatcccaattgctacgtttctaatgcctctgtacccttagatattacagactgttaatggtctactaacacatccaaattaaactcaaaattcatttcctctcagaaggtttctccaactcctggcctcaagcaaacttaggagataatgggggtctttttttttcacagtggcttcctgtgggggtgtaggcagaaaggtcagaattataatacctagagagcttttttaaaatatccatatgctgagggcttttcttccccacatgctgtgggaatgagtgcaagaatgtataatataaaaattttccaagctacctttaaaatccagtacttccttttcctatgacactacacagaaacattgattcttgactttataactctttttttaaaaagaaaaaaaaagaaaaaaagaaaagatcctgtatttctaattctagtaagaaatttagacagagcagagtaatatgttgactttataactcttgtacatactcagtcactgtgcagttaccttattttttaatagtttagttttatatttatcacccttaccaaactccttgacagcaggaattttatttttttaatcccaagaaagtataatgctaaatacttgacaaaaatcagtaagtgtacttttgtgctgacacaggaatgaatatgttttaagaccattttacttattgtcacttaactataaatctcaagtagaataacaaaatgcgtgttgaaaaaaagtttttttagatcccaacagagaaaacacagtctaaacattaaagttcaaatattttgttttataagaaagcccccaggtcatcattcacttttactgtaaacaaaattataataaggttagttttactttactagttaatttactcatagtaaattgtgtaaaaatattgagtggtttagctgacatcttccacagaaagatgcatcatcagcagtaagaattgatagcttgacagactatcaatagacacaaaccctaaaatagacacaaatcctaaaacagttgagaactttcatgtattttaatttaacaataaacatctccatagataagtcactcaggcacaacaaaatcgaagccaaaccaaacaaatcatatttataatctaaattgtatcaaaagagttaaaatttttgatatttgataccatataaatatgatttataatattattaaatactttgaaaatagaatgcacataaatatgcattgatatactttgaaaatacactgaaactagaatttacattaaaattatttaaaacatatgtattttagctacttatgtgatagaacttaagtaccacagagagaagtggtcacattatgagtgcataatatgatgaacgttgtcatagaaaaatgaattattactgtgtgatcacaaagtcagctactcactttgagttaaagatttatgaaatatgttagagaggtgttaactgagttgagcgttaaagaatgggtggcagttttgcaggagtgaaagcagaagctcagagaacctggtgtgtttgagaggaaggtaagaaggttcatgtccttgaagcataggaaggtgaagattacagataagttcagagatgttgaaaagagatggaaagcctcataggctatatgtgcatcaacatattggcaacagggagttagcaaaggtgtttatcaaggtagtggcatgagaaaatttatttgtttctttgatttagtcagaaaacccaagtggttgagtggagaatagatctggtaaagttaggtggctatggcaagagttcagaaaatttatttttaaaggtctgaaaaaggctaaagattaatggtatattaaaaaggtatttaggattgattggataggagaaaattaagagatgagtggaagctttaatacatacatgtctgattgaaataagtgctatacttttccttagaggggatttgttttcaaaataaaaattatagcttacttttcaacttttaaaaacagtgtctgtaaaaactatttatctagcttccctggaaagatctcagttgttctggttcaatctcatttcctcagaagttagactttccaagttaaatgatgatgaatgataattattctgtaatgaaacctcaacttggcatcaacgaacaagacaacatgaaatggggattaaaattttgcatctaattactatattttagtaatgaagatgaacattttggtagtttttagatttcaaaaggcttgttctatcatttttgcttctgtagaaactctattgaagattgtctagcactctatatcttaatgggtacaatgcaaaaaataagttagttttaggaaaaaaaggtattaaattttaaaatctttaaaaacaaatcaacctaattttaattacatgattgtaggacatttaaaagcggacatcagctgaaaatttatgtttcagtgaatacttaaaattttgagaatatacaacttacattttcacaaactaagtgaattgctaaaataagatgaagtctatcaaaatgtcaccataaaatatagctaccttaatatgaataaacatgaagaagaactgaatggcttcatagaatgtgataataaaaacatgagcatgagaagagtgccgtgtccctttacattgcttccaagcttcccttttgttgctcttccttctgcatatgtatattcatttataagaacataagcaggaaagaagagcctcaagaaaatcccaaaaatgatttaacattgtattcttgctgttttatatatcacaatttattttgtatggtggaaattgtcttcaatatatgaaattcaggctcataaaatgatgggctaataaaatgcaagcttttatattaaaaatagataaacatatacattataatactatcatgttagtcatttgtggaagttgtacaaaatacagcaaccctgtaaggcctataggactttaatttaaggaaaatgtaactggctggggcccaggtggggggtgcaaatattgcaactttttcatggttatgagtactatgtggtagatctgagtttaattttttttttatttacaatgtatttgttcttccctagtataaaagaatagttgagcacagaggagtgttaaccatatggcctgtgttcaaattctattcacaccattttctagcttagtcaagttactagatcttttttcagttttctctagtgtagaatgaagaaaataatggtactctgagaactgtttggtttaaatgatgcaatacttcctcatcatttaaattttgccggaccaattaaacactaataaatattgacttttattgttattctccaaaaatttacattttatttattaaaataattaatctccaacttcaagatctagcagagaaaatattttgactattaaaatgtaatatggcttcaacatttagttattaatttcttcctcttacctacatggcttattatcagcagactggcctaagagcaggaataatcatcgtagctttgtagtcccctaattctataagttggaaaaatagttagggaactttttaaaatatataatacttttacgattaatagtgatttttgaaaaaaccttttctgcctcttgaccatgtggttttcaaagattgattatattttggatgatttcacattagatagtaaatagacacatgtcaaactaacccagagggaaactgggagaaattccaatgagtattagttgaattgaacattgtccccatcactaaaatgctaatttacattggctgtacagctaaagctatccatgtcaagaatggaagatctaatatgtatcttgatcattttttgcctgaactgcagtcagctgttgctatggtcaatttcttttctgtatctttacagtataataagaattctaataatataataataataataatagtaacagcagtgacaaatatttattgagcatctgtcaaatgtctggtactatgtatataattttgatatatactaaataatttgatcattacagatactgaggcaagtgtcaacttgttactcacattcagtatttttaagtaaggagtttgaggctcaaaaacattaaaattcttgcccagggtcacacagaataactggtattattttatctcaagtgttagatctgttgttctgtgttgtgatactgtttgaggtattgaatggaaggagaaggcagattatctgcaaatctaactttaagaaataggggcatggatctagtctcatcttccccaactggctaggtagtttccaactggccagctggaattttcccatcctgatttaagtaatgagcagacattacactgaaagtcattgcagaattctaaatcccagcttctcttatttgtggattagactctctgagtcacaatgactatgaatcctctcataactaacaatttcattaagtagaattatttctgacctcatagtcctggctaaaatccattgaaagatattagtttatgaaaaaagtaattaaattcactgttaatgaagaaaaattaaatgattctgtataaacagaattttaaaatagataatctcctctagattgggaggaaaaatactgagatggcagtgagcaatctgaaaaaacaattaaaatacatttctattagagcagtgaagctattttatatgatactgtgatggtggatatatgtcattatatatttgccaaaatccatagaatgtacaacatgaattctactgtgaactgtggagtttagttagtgttaatttttagttagtgttaatgggttagtataatgttaattagtattggctaatcaattttaataaaggtaccatcttaatgcaagatgtaaataataggagaaactatgtgcatgtctgtggaatagaaggaagatataggaacactactttccgctctttttttgtaaacctaaaacttctctaaaaaataaagtctgttaattaaaaaaataaaatgtatattctaggacataagatgagttaaatagaaaataaaatgtgtatacaagaagtggttatctacagtccctatgctgaactttataaaagtgtcatttccaatattccattttgtctgtcatcagaccacttgtctccatttcaaagccatatcaagagctcaaaatatgtatgcatggaattgagttggagaatgtcaattctcatacctaacttccagtaatcttgctggaatggccctgacagttttaaaacagctacaaggaaagacttcaacactgtcatttaagtggatgtcacaaagtagatttcagttaaataacaaaatgatttaactttccttgaagaacaatttgcacaaaaaatgaggaaactatttacataaatgactggcttgctcatgctaaaagagaatttatcagaattctctggcagattcagttttgcactcttaatttatttacagtacttcagattaaagaatttcacaacataagaatgttgtaaatatttaagagatgatgccttagatcagcaattcctaaggacctctctgtttaaaatttatttttcccttatacttaaaatgaagattgggattgtttataaatattcatttcatggatatcttcccacaactctcttcttacagcaggagccacctgctctgaacagccttagagtgcaaaccatactaaagggaattggtgaatgccagaagacagtggtgttaagtgttggctggcttcttaagctccctcctccatacggcaagtccaaaagtgcctaggcaacgagcactcagagaaaagatggctattgggccactacatacctatactctgtaaagtgcttttacaaaattactgttactaagcatttctatatctctgggatgaagaatgtctaaaaaaattactcttacattcagaaatttagggcagccaatttaatagctctagctctgtttgtatttgtttgttttagaataaaaacaaatttaagcctgaccaaaataagagataaacaatagatttgtaaacaataaagtagtatgcaaataagagataattttagcattaaaattccaaattaaatattgtaatttatctagcttattaagcttttttatacttcattttttattttttaataataatcaccctacctgaattctatatgttaaaatcatttagaagactgcatggtttttccagggttttagtataggttgtaacaagtcactgtgtcatgtaattgtgttcatattgtcttgtaaatgacagtgtcctaaagtgggatggacacaagatttgcaatcatcatatctcaattccttatctagctctgtcaccctcttaggtgtctgacttgggttataatttcagtttgtcaactagaagaagagagtccaacctactcacacaatatctgaaacatacttgttggtgaatggatccttcactgagccattttgaagaacaaatgagcttacatatgaaagtttctttgtaaacaataaagtggtatgtaaatatgctgtaaaatattcagatagttgcaatatctgactataaatgatacaaaccatggttatttctaatttgctgatcatttgaagaagtctggattcgcaagttgaaacttttaacccagctgttcatttatgataaagctttaagagtgacaccatcagtatatatcaggataaccagattcctctctttccattacttcctcctcattcctgaaggacttcttgataccagcaagttattgtaccttgactactattttaaaagctggagatcaggagatcaaaatccagaacatgaatttcattttgattaaatatgttccaattttgttgacactgatattacatattaaaaaccagtttttcaatgagctatatttccaaaacaacactattacataaaataaacagcatcatcagaagttacttttgtatattttaatttttgtgagacaatgttgcataagaattttggaataggagaagaaagagggaatgataaacaggtaaaacctactttgggcttttagtgttttgagttactttcattatcaacctgttttttttttaaataaatgcaaaaaataattttagtatgtacgatcttattaaaaatgaccttagtctaagtatttaaagtcacttagatgttaacattgtgtttaaatatttggtctttaatgaagcatttttttttcaaattttatttatacaacatattttttattaaatcttagttgtaactttaatatcattgtaataaagccttagtactgttcagattcccttagagtttgctagataagttttttttctatttaatacttataaaactggcttaggatatgtatggctggtggcatcaccttagatacagctcacaaagtgaaaggacctcaggagcatactcttgaggcacaatggggatttaagtgccttctcacccgcatgtcctagagaagatacacctgggcactaagactttcattttaatgcaagaccttgagactctgaaagtggaaaaatctttggagagacccaaagctggatttatgtcttagagacatttatcagagaagtgtgggtactatttttttaattaaagggatggtggttagattgttttatctccattgttgtgttaatggtcatatgcttcatttttggatattgagtggtagacaatgatggtgcagcacacctgaattaacttctccaaactgctctgtgtggaccccatcagtgccagaggaagcagatgtaagcttactatgtagagtccacaaaacacataggcattcatatatgttgggtcacccattaaactggtcacatcagagggaaggtgactttcataagctgataaatttatattctacatcagctacagtgatgaatactgatgccatctgtagcacggaggctctaacactggcttgagattagtggttataggaagcagtaggggtagaaataatggagacaagattctagtattgacctgggctcatgcgggaagccattacctgtgagctggtggcatccttagttgccatgcatcttctgggtccatcttttgaacaatggcaacagagttctaggaagcaactcatgatgatggcagaaaatcttactagacagctttagaaaacagaagcaaccacagtccttgaaaactaatgaagaattagccttggtacaaatttgcgcagttcagatcagctatagttcagttggcagagagcagttatagaaatagcttttaggtgtatctcatcacagactacaaccagtaatcactgccccttagagaaatcatatgagctgcaaaatatatgtaactgaaccacatttggtaacatattgaccaccaatgcttgtgaaagttctgaggaatatcaacaagggagggaagcagagaagggataatttggaatgaactgaattatcacctcagctttgagattctaacaaagttaaagaaaaactatgaaacttcttcagaggatgccacagagtctcagtggattgtggcatcatccttttgtcaagagctaatgagaatccatttttttgcttaaagcacaggaaacatggattgattttactaaacactacatttttttcttttgatgtctgtatggcattatttatatgtgctactgactacacagtatagtttgaatgttgaacttccaaatgtatttatagttcttcttattcttgatcataccactatcacataaatgagaaattattccttacaataataattttctctcaattcaatgtttcagctgctttgctatatcttaaattatttgatgctgggctctatatcatttcaccttccgtttgtaaaagattttgattgatattggtttcatattttatatgtcttactgttaatgagctgttttacttttttgatgcaatacattgggtctgggtcaaaaatcatgtattcctatcttttaacatggctggaatattactaattcacttaatataagtggatttatatagaagcctagatttagctatggattgattgaatgccattttggtaaatgtaattctgaatagcaaataaccaaatatcttttattctgtattcagtaaattttaatttaaagaaaagtgatgcaaggtttacttggtaaatgcattttctgaatttcataaatattctgaatcagtagtcactcctttatgaatctgtaagaggccaaataacaccctaaaataaagtttctcttaaattgcattcttattgtaaagaaaaatagcatataattgatgaaaaagctcacaacattctttcctccatctcctaaaatctgggattataaaaagagcagctgtacaacaagcattcaggccttttactattagaaagcccatctgtttttctgtacttttgcctaaatttttaataattatgtctagacatgtgacaaaaacacatagagattaactatttcttcactgattacaactttagaaatgaaccccatgaaaattcacactacataatttaattagttttattttaaatacagagaatgaaaatttcatcatgaacagggtttcaccacgttggccaggctggtctcaaatgaccctcctatttttaacttggatacctgctattctgccaaaagacagtttctagagtagttttgaatgggttgatttcccccagtcccacaaactctgaagccagtgtctagcttactaaaaaaagagttatacataatatttaagatgctgagtatttcataggaaagctgactgctgctgtaaagtgctctttaaatcttttttttaaatccctttctaatgaatgaaactaggggaatttcaggggacagagatgggatttgttgtatgataaactgtatgtagttttcagtctttctgtattgagaagccgtggttggggcatttttaagatggctggctactcttgttttccctcatgataataaatttgtcataactcagtaacatggacttgcccctagaggtagttgttaataattttgaaatattaaggtcttgccaagcttctgatgattcaaacctgtactactgattattaagcaggacagactgagctttctgctgcaaataccttggaggagaaagtaatttctaaatatacagagaggtaacttgactatatatgttgcatcctgtgcctcccttcatattaatatttgataaagattttaattcatataaaacttctaaagcagaatcaaagctcctcttggggaaatggcaagtctttaggacaggcgagaccctgtatgcatagtaccaaagcattaccacatggtagagaacacactcgattaaaaatgttaagctatctgaaaaataaaatatgcaagtcttcaggatggcacaaaacaaaggttaatactttttgggacacatttcttagcgggcttgctgagtgtgtaaatataatcaacttttgtttgtgttacatgactttgatgacttcattgaaaatctgcacaattcagtttcagctctggataacttcagttgacctttgtgaaggtttttatctgtgtagaatgggtgtttgacttgttttagcctattaagtttttattttctttcactctgtattaaaagtaaaatttactaaaagaaaagaggtttgtgttcacattaaatggctttggtttggcttattttagtcaggctttctgaacattgagatatcctgaacttagagctcttcaatcctaagatcttcatgaaaagcctctcacttgaacccaaaccagagtactcttactgcctcttttctaaatgttcaggaaaagcattgccagttcagtcttttcagaatgagggagaaacatttgcctgccgtataataataagactcagtgcttattttttaaactgcattttaaaaattggatagtataataacaataaggagtaagccaccttttataggcaccctgtagttttatagttcttaatctaaatattttatatttccttcttttggaaaaaaacctacatgctacaagccaccatatgcacagactatacagtgagttgagttggctctcccacagtctttgaggcgaattacaaaagtccagccactgtcatcctcctgagttattttgaagtgattttttttttttacattttggctgcagtattggtggtagaatatactataatatggatcatctctacttctttctttatttatttattactagacctcaaccacagtcttctttttcctcttccacctctctttgcctgtagggtgtactgtatgtagtcatgtactttgtattaatatattagaaatctacagatctgttttgtacttttcatactgttggatgcttataatcaaaacttttactagggtattgaataaatctaatcttattagaaaagaaaaaaaagaaaatttagtcatgaaatacacagacacacacacatacacacacacacacacgacattcatttgattttaaaataccattgagtataagatgcgacattaaaatgaagattaatggtgttttggaaaactacataagtattgactatataacaatcaaattttcaaaaatgttatatccaaaaatttatgtatgtcaaaatcaacaaaacaacactatgttatttctacccttaatataagtgcatatatatatatataatatatatatatatatataaagattaaaagaattctgccagttctgatattgttatataatcatatatagaatatccatatatattggattagggtgactaaaaattaccaggcaaatctttaactaagccatctttcatgtctatgcaaacccaactcagtataggttgccaatcctgcagccagggctgcctataagatagtattgatctggatccctgagaactcctggaatctggagaactgctttttctaccgggacaacactgatgtaagcatgacagggcatgagaaggtaaagtgagagatggttgctataagtttgacatctgcttcattttggtgcagaagaccacaatctagatagactcttgggcagtaccagatgacactgccccagatgtaattgccagtagtgagcaaacctatgaagatttgaccaacctcaacaaggcagggacagctgccaaggatggtgaagtccaggaaatcatctggtgttttatgaagtccggtctcctgagaaggagcctgatcacctgttttacagtaacaacagtaaggttaaagtagacatgaaaaataaaattgtctcccatttgacaattttatctttcatatctacttaccccaaagaatctagtcagaatgtctctgggcatagttccttagttcaaggctttgggtagtggtctctttaccaaagaccttcttgagtgaagacaggaaggaactaagacgtgaccagtgaagatcaagtgagcctaaggttacttctatcagccaatcttactctgcaaaactgtcccaggtagctgtcatctttccagtgaaatagaagatgaaggtaaccagtattacagttttaaaaaaatcaatgtttttagcttgactcctggaggatccttgttaagatcaaacctgaatatttgtctgcttatatttacagttatatatatactatatataatatatatacacacatatatacaatttatatactctatatatacacacacacacacatatatacacatatacaattcaaaaatgtagaaattcagatttctacttccaaataaaataatatagtcataaaatatttcaagccatttcttattccactgtggtataagctccccaagtggtaggaggagtacctcctattgtatatttcagaatccgttccttccttaccaatgtgtgtctgtgacatacccttaatgtccttgataatgtccaattatgtctttcactgcatcaccttcctaaagcatgttctagttacttggcttttccacctgggaacaatatcaattttagtataattacctgtctttctctttttttgccagaataatatgaaaaagaagtgacacgcaattaacaataattattatatctacttacatacatataattgcatttttgtattctcaagaacgtatacttttagagttacaggttacatgtgtaaaagacaaacagcttcagagttaaatacatccatgacattcataatatttagataagaaacattaagagtaaaggacaagacagcgggttccatctggccttacaaatggaaataaaaaacttactatcttttttttttaatcctggtctgtattgattctcatcttttaagccactatcaccaagagtcttaaaaataagaaagaatgtttaggtttatttatcaacatttgttcacagcaccatcaatgatctagaagaatctgcaccttccttgacttcttagatcatctgttttccagccccttctatggactttctggagccccagacctctcccaacatcctctctattttcctgctccccttggcatttccctctttacttttttcatgtttaatatgttttataaaaaagaaaagtcattatatgagaatttaaagtaatacgaaggtgaggaatctaaagctggataatttagtgccagcaaaggatggtttaatgttttcccaaagagattgactttaaaaatgtcaagataacaggagaagcaacctctgttaaccaagaggcagcagataagttcccaggcaccattaagaaaattgttgagaaaaaaggacacctttctgaacctgtttttaatgcagggataagtgccctattctgaaaaacaaaaacaaaaacaaacaaacaaaaaaaaacagacaaaaaatgccacaagggacatttattagtaaggaagagaggcgagcaccaggatttaagacagaaagtaataggctaactgtaatattttgtgcaaatgcagtcaatttataatcaggactgccctattaaagccttgaaaggaaaagataaataccagctgccagtcttttggttgtacaataagaaggcctggacaatgagaatcctttttctggaatggttccattgatgctttgtccctgaagtcaggaagtacattgttagtaagggcttgccttttaaagttcttttgatattgcacaatgcccctggccacccgcaaccccatgagttcaataccaaagacctcaaagtgttctacttgccctgaaacacacgtttctaattcagcctgtagatgagaaggtcataagaacctataaggctcattacacatgttactctatgggaagtattttcaatgctgtgaaagagaaccccaatagacagaacaccaggaaagtccattgaagatgtcattgttcttatagaaaaatccatgaaagccacggaagccatcagattcctgctggagaaaactatccagatgttgcacatgtcttcacaggatttacaacagagccagccaagaaaactatgaaagagattgtggatatggcaaaaaaaggtggcgaataaagggttttcagatatagattttgtagaaattcaagagctaatagacaccacaccacaagaattaacagaagatgactttatggagatgggagcttccaaaccagtgccagaaaacagaaagtatctgattattcaagaattcctttgctttttatgacatggtcccttctatgatacgagcactgaaataaagcaaatgatggaaaaaggattggtaccatatggaaatatttttagataaatgaaaaagcaaaagttagaaagaaattatgatgtatttccataaaggtacatggagagtgcctgcctctcctttctctccttccatctccttcacctcttctgcctctgtcatggagacagcaagaacagccccttctcttccttcttctcagcctaatcaatgtgaagataatgaggatgaagacttttataacgattcactttcatctaatggatagtaaataaattttctcttttctatgattttcttaataacattttcttttctccagcttactttgtcatacaaatacagtatatgatacacataaccacaaaatgtgtgtcaattaactctttatgctattggtacatcttccagtcaacaacaggctaatgtgccaatcaatgctttatgctattggtacatcttccagtcaacagcaggctattagtagttaagtttaggggaatcaaaagttatacatggatttttgactgcacagggcgtcagcacccctaagcctctcattgttcaagggtccagtgtacatgtatagatattagtgacaaaggaagaagtgtgtaaacactcaattaatatcttataataagtgatataaaaccttcagttgaatttttgagtattcaagcttgagcttaatttggaatatgggcaagagggagtacatacaaaaacaaaggtgtttgtcttttaaaaaaattttgagtttttccttttgagttcatgcaaaaatgagaaggttgcaccctctccccacaaccacccaagatttgaaatgtgtaagaaaacagaggcaagggaggagaaaacatacatggtatggaaaaaaaaaataatagaaaagtggaaagacttaagttaactaatacttaattttaagttgttcattttgtagaagtgcagcacaacttttgctcagacattatgcaatgatacataaaagtcttgggaagggaggaggccggctggtaggtaggtggagggtgataattttgtatgtacataaaataaagtggtgatgtttctcatatagttcagtcacaaagcaaaggaaaaaagtgaaatgagactggagggggaagaatcaggatccaaggcatagcatgttagcttgggggaaccagcccctggctactgcagccattccagctagaacatcagacacgtgagtggggacactagttaagacgactccaggtgttatctgactgcggttgcatgaaagacctccaaatgaaaccacgtagctgaggcccaccaacccacagaggtgtgagacagacaattaaaacatcaccatatgaagacactaaattttgggtttgttgcacagcaatagattattggaacacactcctttaccagattactaatgagaccatattttctccttgttgattctttccaatttattcattaaacatttattaaaagtcatctcctatgacaggctctgggtataataaggtaaataaaacatcatactttcctcctatggactaccctcagttatataatttcttctcttgaaaaatcttgaggggaattaatggatattttagtatttgctattagaacaattagctaatactctgtaataagttaatttagaccattttttcaaattagctggagaaaattttgtttttttaaataaattataatgcataaaatatagatacaggtgaaatatttgtataacctcctggtgagtgaggttatacaaatatcaagaaacaaaaagccatgaatcaaaaaatttaaagagttgactccatgaatggaaaaaaaaactttattgtggcagaaagcataataaacagaataaaagaacaaatatttgaaagaaaataattgtatacctatgacagaaaaaatgttaagaatgtttaatattaaagagctcctagatatttataataaaatggcaaaccaataaaatatggaaatgcaatttatggaataagaaatgaaaattagaaatgaacatataacatatttaaaatcattaataggaagaataaaatttgaaagaaattctccttaagagaattttttccagtaagatcttaaggtcaataatgtctaggacatctcttaattcagtttcatacagggaacaggcagtctgttatgcaacttgattgctaaaatcttttctaaattcagtattattgtactttgtgtccaagtagtaatataatcatcttggaaaatacttactttccaaaataaaatcatcttggtaaatacttattttccaaaatagttacaatgtagtataaagtgaaaagaggataatctttgtgtataagtaatataaacaaccttaaaattgtctgttaaaattctacaaatcccacagctgagcacattatacagaaaaaaaaaagcatcagtatatgtggatatatatctcatgcttacatttgcattgtttgaaaaaacataaatgccaatcaataagaattgttaaataaaaaagcatatattcaaattgtgtagtattatagtatgcagctattaacatgtgtgtttcatttataattattgacttggaaaaatacttatattgttaaatgggaaaaattaaatgtgaagtaattatggcatgattcatttttactgcccaaggtaatttacagattcaatgccatccctatcaagcttccaatgactttcttcacagaattggaaaaaactactttaaagttcatatagaaccaaaagagagcctgcattgccaagacaatcctaagcaaaaagaacaaagctggaggcatcacactacctgacttcaaactatgctacaaggctacagtatccaaaacagcatggtactggtaccaaaagagagatatagaccaatggaacagaacagagccctcagaaataacatcacacatctacaaccatctgatctttgacaaacttgacaaaaacaagaagtggggaaaggattccctatttaataaatggtgctgggaaaactggctaggcatatgtagaaagctgaaactggatcccttccttacaccttatacaaaaattaattcaagatggattccagacttaaatattagatctaaaaccataaaaaccctagaagaaaacctaggccattccattcaggacataggcatgggcaaggacttcatgactaaaacaccaaaagcaatggcaacaaaagccaaaattgacaaacgggatctaattaaactaaagagcttctgcacagcaaaagaaactaccatcagagtgaacaggcaacctacagaatgggagaaaatttttgcaatctacccatctgacaaagggctaatatccagaatctacaaaggacttaaacaaatttgcaagaaaaaaatcaaacaaccccatcaaaaagtgggcaaaggatatgaacagacacttctcaaaagaagacatttatgcagccaacagacacatgaaaaaatgctcatcatcactggccatcaaagaaatgcaaatcaaaaccacaatgagatatcatctcacaccagttagaatggcgatcattaaaaagtcaggaaacaacaagtgctggagaggatgtggagaaataggaacactttttcactgttggtgggactctaaactagttcaaccattgtggaagacagtgtggcgattcctcaaggatctagaactagaaataccatttgacccagccatcccattactgggtatacacccaaaggattataaatcatgctgctataaagacacatgcacacgtatgtttattgcagcactattcacaatagcaaagacttggaaccaactcaaatgtccctcaatgacagactggattaagaaaatgtggcacatataaaccatggaatactatgcatccataaaaaaggatgagttcatgtcctttgtagggacatgaatgaagctggaagccatcattctgagcaaactattgaaaggacagaaagcgaaacaccgcatgttttcatttataggtgggaattgaacaatgagaacacgtggacacagggtgggtaacatcacacaccagggcctgttgtggagtgggtcaaggggggagggatagccttaggagatgtatctaatgtaaatgatgagtcaatgggtgcagcacaccaacatagcacatgtatacatatgtaacaaacctacacgttgtgcacatgtaccctagaacttaaagtataataataaaaatcataaaataaaaaagtgcatgtaataaatttgtatatttggatatactgatctagcatagataacatatataaaaatgtacataaaacttagcagtatttgactaagaggtaaaagattaaaaggagttaaagatggttacgtttattctacatatatttgccatatttaaatatattatttttctacttttaaatatcttatttctcatatcatttgaacctataattctacttctcagaagtcgtcttaaggaaatgataaaaaagtcagaaaagagtggagaacaaatattgtaatccatattatataaattgactaagttgaaaatacccaaaaaattcagccacagggaactgattaagtaaatcaggttgaagtcttaaatatgacacttgttcacatcaaaagtatgtctttcaaagaccttttaatgatcttggaaaataatagcttttaatgatcttggaacataatgatcttggaaaatgatattggaaaatagttttaatgatcttggaaaatatgataattgttcatgttaaaattatgtctttcaaagagcttttaatgatcttggaaaatagctactaatcttggaaaatacttggatgtagtataaaatgaaaaaaggaagataatctttgtgtacaagtaataatacgaacaaccttaaaacacaattatgcctatagacacacacacacacacacatacacacagaaagaggaaaacaatctagaagaaaactattgtgaggaaatcttgccaggacaaggagtgatattagtttcattttactttttagacttttctataatttctgaaatttttataagtgtcattggttttctaattctcccaaagaatatatcagagccaacatgaaaatatcacaatgagtcaggaattttgtgaattctttaaaaagggattagttgattatccttctaattaaggtaaaactttgtttctgatatctgcataaaattaattatttcacatgcttattcaccaagttcattatgcataaaacaaaattaaacaaacaaaaacgactccatgaagtagtactgaatataatgaatatcctgaattctaaaactcaatgaaaaaagaactacttgattcattgcttaaataattataaaaatgaaattcaagaaataatttgggaagatttgagtactaataaaaagaggtaatagttcagcaaattgaagacaacagaatgaattaacactgttggaaaaaaatttgccttcagacagcaaatatttccacttttccgcagagaccatagtctttcatgccttatgcaatatagcctaaccaaatatttagataatctgggaattcaatttaatgaaacagcctcttttccagtacattattagtaatacattagttttcacagtgatttagcaaatttatctttctaattattttggttgaactaacgtcagcaccctgtagactgttcttggtgcaaaagaatatttcttccactcaggtctcagagtttggaaggatttagctagagattttaaatttgcactagttaatccatcccatgaatcattaacttagtataaaaaataaacagtggcttgggttaagcatagcaatttaaatattttgcagagattcaggaggaaatttaaaatggtcagtagttttgaaagaaataatagcgtactttgtcaagtattccagataagggaggtagatactatatgaataacatgctagttattactatatgaatattaaaataaaagcaataaaaataaaacgtaagcactagaggaataaaaaaatattgatgagctgctgatcactattactcataagaagcatggttttgtttgttttcttaaaatttggaccatcctctcatttttgatggatttttttttcccttaggttcaaaagcccactgaatgtttcataatgtaataaacattaaaaactagtaattatatgcattagattatctacagtaatgtcaattcattttttgtagacaagcatggtgcttagctattaaagaaaataaatgttagtggccaaatctccaatgtgtatatgcaaagctatctacatttaatattcactactgatgtttaaaatttcaggtttaacatggacattatttaccatgaaaatcataaaatgtagttatatttcactatgtgtttgttagaaccatatggaattgccatttttaaaaaatataaatgttgaacatggccaatttgatatgcatttacctaatacttagttctccccagatcttaaattcgtctttaggtacactacggattgtagaattaggcatactgaagacaacattttaaattttttaatgtgtaaacttaattgtataaagcttgaagttctttattagttcaagcttcatattttctgtggccctgctagacaagaatgagatgaaactctgccctgtgtgagactctatcaattttgttaataaatgattctgcaatttatttttcctgttaacactatacaggtgtgccaagcaagagatgtattgtactggttctagtctcagttcggtatcagaatgactagagcagcctggggagataataaagcttttgtattctccataaacccttctaacaacaagctggtgaatataagagaccccagcagacagccagtcaaatttaagcttctatacaaagacttcatctatagaagcttatgagcagcaacaactgaagagcagtctttgagatttgcgcatgtatctaacaaacatacttttcctaattccttttacaaaaattaaatcttagtagaaaaatatggtcactctttaacaaatttttaaaaattaaacaatttgatttacaatatgtttgcttctcttttctcctccttcctcctctcccattgccaccctttccctcccttttctttgtccttttcattttaatgtccaaggctattaaagaaactacatgattttccttactcttactttaaaaatggtgaaaaatttgcattgaattcaaagtttagccaccattgtggctgatgcccaactcttcttttcttctttactgtaagcattatcgtagcctgggcaaagaaatccacaggggctggcaaacaggctctttccaaaagagaatgtgtttataaacaagtgtttgtcctctctattcaacctttacctattcaaggaacaaaagctaactttattcatactttgctataatttttcctcttactatttttggtgaagggtaacaggaaaagtaagatttgaattttttcaagtagattgtatggtaacatttacattcattcatttattcattctaatcaacctcagttcctgaatctttgatgtctcttataggtgaaaggatttttaatgcacctgtgagccaatttttggtttctgaagaggaggaaggatgcagagtaaaaggaaatgtaaaagtgttgtacaccagctctcagtaaccttagaagatttatatgatgctgcaacaagaaaacaggctctgcaaaataatgtgctttgtgacaggtgtgaagacagaggtggggaaaaaaaaaaggaacagtacagtgctgtcataattgccaaggtattggaatgcaaataagaattcatcagatagaacccggaatagctcagcaaattcaagctgtgtgcatggagacccagggccatggggaacagatcagtcctcaagatagatgtaaaagctgcaacagaaagaagatagttttgggagaagacgattctagaaattcatattgacaaaagcatgaaagatggccagaaaataacatctcatgatgaaagagaccaaaaaccaggactggagccaggagatattatcattgcattagatcagaaggaccatgctgtttttacttgacaaagaaaagaccttttcatatgtatggatatacagctggttgtagtattgcatggcttctgaaaaccaatatccactcttgacaactgaaccatagtcatcatctctcatccaggtcaaactgtcaagcatggagccatcaagcatgtgttaaatgaaggcaggccaatttattgtagaccacatgaagagtcacttaatcattgaatttaaggtaaactttcttgataatggctttcccttttttgacaaactccttgctggaaaaactcctacaaaagagtaaagaagtagaagagactgatgagatgaatcaagtagaatttgtggactttgattcaaatcaggaaagatgatgctgatgccactacagtgcagaagcaaatgtgggaccattacaatggaaaagcatgaggatgataaacatcatttcagaggtgttcagtgtcaaacatcttaatgggaccagtgataatactcgctgctggcattttatgggcagtagtgaatgagcaaaggactgtaatcctaatatgctcactacttgctattgttttggttttactattcaactagagtagtgttttaaaaattaaaggaagaataaatacaatttttttaaaagttgacaaggatgagcatggccaacaaacctctctccactttggcaacaaatagttttaaatttggtttccagagtaagttaatagaaggtataacacagagaaccagaaatacaaagtgctctattagtgagatatcagaagtgattattgctgattattatctgatattttataaaacaatctcttttgagatattaaatatatactgagattcataaaacggtagatacctaaattatctcatttagtaaatcagtggggctatttaatccagataatttaaaccctaagaataattttattttccagtagattgacttttacttattttatttattttcttttacataaactcagagggaattacactttttaagaccatgtcatttaatatttccagttttaaagagaaatagagtatttggcataatgaatgcctattttactatttgtctttatgtcatatgtaatttttcctcttaaattttattttaaatgtgtttcaaagtccaataaagggaacactaatacagattgtaattgtatttcagtaatttaaacaattcattctataactgtgtaactttaagcatctttacacaaattatatatatggaaaggacaggttccttctttaagctttccagtagcatgtttggaaatattttccctacatggagcttaaacatgttatttgtggcatggaaacacctgagagatttctttggttcacaacactcaggatacaggggacatgatcccagtaatgagctgtttactttgtataaacagaatgaatacaatactcataaatgtaaacaccctgcttactttcaggccagctggaattggagtgactgaataagacaaatgggcttaggtttaacatctttatttttaaaccctttctaagagtaattatgcccttgtacatgctgtataacctttatttctaaccacaatgggacttatttctccatcagttttaccactgttttggactaaattcctctatttgcttatttatttacaattcattgtcttttttctgttccactctactagaatcccaaacctccacttacctctgttgctagagataagttatgcgtatcagcacactctgacaaaattactcttaagctaggattttgaccttagacttatgtgctattctaccttggtaaagctcaagaatacacacacacacacacacacacacacacacacacactcactcacatttgattacattaaaatacacctaaattccatgcttcattaatcattttccatgaattttatattaatcctgtacattaatgagagcttttaacaatttccttttctactgttgaaacttcagtcttctatttaacccatttttggacctttgatccatgtcaagatagcctgtgaagactgttgaactgtttggcaagatctcccaagcagtggtttacaaattgtgtggcttcactactattaggctgttcaattaattcaatgggctatgaacagatttataattgaaatggaagagaataaaatacatcagattgaactttataatttttatgttacactgcaaatgaaaaacttgcaaaattttcagtgtttgtatgaatgtgtatgtatatgcttgtggtaaatatattacttttattacttactctggtttttatttgaaaagttttaaagcctagagcaggatttctcatgcaagagttaccaaataatccatttaaaacataggtaataataataataataataataataataataataaaagtatgcatagtatttgcttatatcgatttatgtaataaaatatacacgtacaaagatatgcaacaataatttataaagattaggaataaatttattattcattttactttacgtagtaaaaatgccagaaagttccagttaaataatacaatttaaataacattaacatggcacatgcacctgctttcctgaatttaaactgaccaggttgtgtttaataatatgaagctgtattagcaccttttaattttcagttgctattgattttatcttttaatattaagaatgttgtgtcgtccttgaatcactgtgaaagtcattcagttattatgcacatttgccatggcacttgttactaaaaactgcagtaagctgatacgttctaagagtggacacagttcgtgcactcacaatttgaacatgatatttactgcagttgtgcaggacgtttttatttttcaatttagcatgcttacacacttttttttttttttttttttttttgagacggagtcttgctctgtcacccaggctgaagtgcagtggcgcgatctcggctcactgcaaactccgcctctccggttcacgccattctcctgcctcagcctccccagtagctgggactacaggcgccggccaccacgcccggctgattttttgtatttttttttttttttttttttttagtagagacggggtttcaccgtggtctcgatctcctgaccttgtgatccgcccgcctcggcctcctgcttatacactcttaacccatacaatatttccattctctgatctcttttctatctgaactgatgcataacttttgttttatatcattccttggcttcatttgactctcactcagaacaaatgcagtagaaaacaacaagtaattgcaaacaacaaaattcttaggagaaaagatgctcacaaaatgatccagaacacgagtggattaattccctttgcgcttatctttgaaatacagaacacaaaacttaacatctgtcatagaaccttccagaatgtattcatagagcttaggatgtccataagtgctaatgtggaaatcctgatctagataatttctccacattttgtaactgcaggtgtgtgtgtgtttcatatgtaccaactacctgtagaaaagtaatctgtgataagaaaaatattgaaagaaatcaaatgtttatgcaggaattatacatattcaaaattaatactatctctatgctaaaaataaataaatgcctataaaatattttaaaatagataccattactaacacaagacagcaattatactgtacttataacaaaatattctttctaaaacttactagaattccgacaattctagtatgtatacaatgagctttgtaaaatggttaagttttacatggcaggagaacactaaattgcaatgctaagtgaacgctactccctaattttaggttgtgaatgccaaattataatgatctctatttactctcttgagaagttactagtatagccctcaagtgaacataagagtgaaaaacagtgtaaattaatggtactagagtgcatattttttaaaaatcagtttgcaaccacaagaattcatgtgggtaatgaaccatacattatgaaacatggcactaaatgtttaaatataatattagaaacagctatgatttaccaacttttagaaaagtaaataacattgttctacattaaaatatgaaataaatctaggtttgatttaatctgggatacattgctgaggatattgattaacataatccaagtaactcatgtgatgcaaagtggaaaataatgatttctagagtaaacagaacttttaagattattattagaaatacagtttgtaagatcacaaacaaaaacacttcctttttctaaggcaactttccaaaatttcttataagtcatataaacaattaatatgttttgactgaggattgactcttagcttgaggtaccatgtgtctgaaggcaatttttattatattctccttctagacatttattttatttatttgaattgggataagaaaaatttttaaaagaaataattcacccttccttaatatttacctacaatagaattatccatagcttactgaaaaaaagtgttttggagaagttatctcatattttcagttttagaaggatgagtttaaaaaactgattatttttgagcaatcattatatagaatataatattgagtggaatatctgagttgggtaatataatctccttttgactgatcaggaaactgtggttatgtagtaaggttgagcaactcacccaacatcatataactagtaagtggcagattgaggatttagtttctgatggattccaaacgcatacagctttatcgtgaagtgtatcaaaactttgaaattatagtgggtggttaaacataactgtaaatggtgttcagacctgacttctccatgtttaaggggttctatttaatcttgagcagtttggggaactaatttatatcagcaagtatgcatttcccataaaataaaaaatagaattgaggccgggcatggtcgctcatgcctgtaattccagcactttgagaggccaaggtgggtggattacttggggccaagagtttgagaccagcctggccaacatggtgaaaccctgtctctactaaaaatacaaaaattagtcaggcatcgtgacatgtgcctgtagtcccagctactcaggaggctgaggcatgagaatcacttgagtctgggaggcagaggctgcagtgagccaagatcatgctactgcactccagcctgagtgacagagcaagactgtgtctcaaaaacaaacaaacaaacaaaaaaaacagaattgaatgacagcagtacaaaatcttgaacatgtatttaattcacttattcagcaattcattcattcattatgcaggtggcatgcagtacacagaaaaaaagcaattatatgaagtatttattgttgtgtaacaaagtaccccaaaacttattttctttaaacaacaaacattgattatctcacagtttccgtgccaggaatctgggtacagctcagctgggaggctctacctcaaggtctctcacaagtccacagtcaagactggagttgtgatcatatctgaaggttcaaattggggacgatcggcttttaaactcaatcacatggttattgctagaattcagttctccactgattgttggactgaggtgtcatttttttcactggctattggccagaggctgcccttagtttctggctatgtaggcctctccctagggaagctcacaacatgatagcttgtttccctcctggcaaacaaaagggagaataagagcagatgaaagagggagaggaggggcaagactgtagcaaaagtgtctttgaaactaatatttaaggcataattttatcacttttgcatattctattcataaaagggagttactaggtggacccccacactcaagcaggtaggattccacaaggacataaatacaaggaatttgggagatagtgtagaaattgcctaccatagcaattaacatgtgttagttgctggtaaacgtttgacatttgaattgcataacttttatatcataaattcaatctataggaatttcctcgcaaaaataactagaaagacaaaaaattctaaacattcttatgtaagaataatttgaattgtaaaaaaatacaaaactgtttgaactttcaataaaaatggaatgaataaatacatttaaaaatttaatatgtaaataaataatttaaactggaaaatttatattttttaatttaacatttaacacataagttacttatttagcttcattctttgttttaatgtcagctctttgttctaatgttagcttcttgtaatgttatttctttgttctaattttaacttcttaaggaacccttttctgtcatattattaccctagaattataggtaaggtagtggaagttgaattgtcacaagaaattacaagatcttcacttgaaatattataggatattcccttattctgcctaattacttttcctatcacttatcatagcctgacattatattaatagtactcatgagtttatttatatgtttgatgtttcccactagaatgcaaattctagaatggcaggaagtttgtttgctttgttcatttctgtggttcaatcatccagacaagtccatgaacacagacttgaaaaatattctgaaatttttctgaagaaatgaatgaaatctatggatagactcgtatgagaacacagaagaaaggtagttaatgagcctgcaagcccttggcatgtttgattaacaaagttttcccagaggaagtaatatttgagctaaaatgagatggaataagggaaagggaaggcttccctgaagcaatagagatatcaatctgtacatatatttgatctcatatgacagctcatgatctggcatagagaaggcattcagtggtttgaaaattggctattggagataaagagagacaagctaatttagtgtaaaggcaagaaagtgtttggcctggacaaatcatggggtcagagctaaaaagtgaaagaagtgaatctaggaaggagctgataaagtagaaaaaaaatggtagagttagtggattggaaagctaaataaagtaaagaaaatatatgaaagagttgaatttgggatatgatattatgattgagatgtaaaggatatttgaggtggcaaggccagaataagacatgaaaatgggtggctaaagtggattggggataaaggttaatggcatctattttgagaacatcctaaaatattaactttacagatttactgcaaatttagaaattcctttcagaagcgggtgcctatatttaaataaattgttaaacctgttcaaaagtaaagtgaaatgcaataattggttatgatatttttggattctctatgacctttctatttatctttaatcatattcctagtaataagtcaatttcaataatataatttattattgttcctcagagcctactatatggtatgagagttacaaagaaaaatgagatttcctcacttaacaaactggttaagactactactggctaagaccagcacccctgctggttttctaagaagtttacattctaagaagtttacattgtttgggacatgcaaaataaacagctgtcatactgttggaagaaccagggaagacttcagaaaaattgtatttgagtgggtcttgaagaatacatagaattttatcaatcatataggacaaagtagaatttcagatggagacaaaaacctaagagaaaatagtggagacaatcaaatgagacaagcatttgagaaacaatgagtactgtacatgggacatggaatgtccttacatatgggtatagagatttagagctggaacggtgatatagagaataaggctacaggaataagagtcgggacttaaatgagtctgaaagttttcaagatgacaggggacactgtcagcaaaacgtaaaatggaaaaggaagtagattagatgcagaaataccaactaggaggctatcgaaaaagtccagcaaggactaataagagcctgaactagaataaaggaagtatgagtggggaagaatgtggacatgagaaatatatggtgatttacagacctgacagataattgactatggggcaattgcaaaggatggtgttaaagatgacgactaaatttcaactgggagaacagtggtacttcaatagaaacaggagagtcagtggaaaagtaataggtataataaattgatattttctgatttgatttaaatgctacaggtaaatcaaagtggagaggtaaaacattcaatttaaattttgagctacaaattcagaagtgaggtcataataagaatttcatattcaagaatcatctgcgtggagatgagataaaaaaacttcagaatgaatgaaattattagagagcaacagggttaaaaatagaacttgtctctgatgagagatattactattgaaaggtgaaaggaggaaggggaaatagaactagatatagaaaaggaataaatttccaaatagctatgaaaaaaagagaagtaaatgatgactgtatgacgtggaagccaaatagggagggagtgcaagaaggagggcatggttggtgaaggacaaccatagttaggagagaataatttcaaaacaatattcaaaagatctattcgatagaataagtccacactgaatcctgattataatggttaaatttgagaagtaagtacttctgagaaagtggtgacatcaagatatgatctatttccataagcttggcagcaagacagggggacagatggtgtggaagcttggaatagtagcatcacagagaggaaatgaagaaattgagcatgtttgccacccaaaagggaaggaactaagtagtagagagggagacattaaagatggaaatgaaactaagaggaactaggaaatttagaataatcaagggaccaaaactacacattaaaagagaaatgtttataagaaagatggtctcagtcaggtgtacaaagaaaagaagtggaagttctgtaaataattgatatgttaaacaaacaccacttggttggttctaactgcagtaatcaatttaaaaatagctactatttgtttaggggttactattttccaggaactgtgcttaacagcgtacgtatactatctcatttaatctttccaacagctccatggagtatgtactataaatacccccattttaaatgtaggaaattgtatcattagagaatgtaacttattcaaggctgtctgtgagagttatatctgtgaatcaaactaagactggctcccaagcccatactcttgaccaccttgctgggtgagtggattgaaatatgaagaatcaccactgtatgaaggataaaagggatttttccagcagcagtggaaatccacttgacagcttggctttctaatgtgttgtatttagtgtggttttgtgagtacttccagaatgtgataacaaagatagtagataatttcatgacttggaaacaagcattatagaagggcagggaaaagaaaatttcaaggtgagagttgtcatatgttttaaatgactgacactggagtccagtctgaatggaacagaagggaagcccaaagagagtggctaattgaaagcacagggcataagcaagggcctgggcaacacaagaacaaagacaattgttaggtagaagagaataaagaactgtattagagaggagtttaattctttcaaaagtatttatatgtcaaactgatgacactaggataagcttaggatattcaaaggttaattagacatagttctgcctgagagaaagatttaataccaaggaaaatgagtggaaattggggttgctgcagtcatggagctaaggaactgaagccacagataggcagaaattttagtccgtgcatgatgttaactgttgagtttgtaaggcttataatattgactttagtaaggttgtatgctatatagtttttattgcttttgctattttatactttgtttatgattagtgacacttaagaactgcttgtttacagattctgctaaaatctatgtttcctgcatgtcctatcaaagaaaaacaatccttgaaaccattttgtaaaaatacagctttatatatttcaatgcacgtccttcttaaggaaatttggtatctgaaaaactgaaacaaaacattgtgatattttaagcagaaacaaagatttttttaccattataatacttatacatggcaatacattatttttagttattatttttaaatgactgattacaataaggaaatatgattgtgtttgatttattaatatgatactggacacctctaaatttattaacaaagtaatttttattacttttttattcagagtgctttggatacaggaacaaagtatccctttatttcaacaaaaccaaactttttcaaaccttgccttttccataacaactattatttactagagaatatgggcaattgtagggaattttttgttgactcagtcatccttatagtttgccaagttatagttctttatattgaatagcccacaataacgcactttcttgaagaaactgtttaagatcatcaaaaaataaatggaagaagttaaaagaaaatgttcttgaatgattgaagatgggagaggatatggtcagggtaaattggaacagaactccaaaactaatcatgtcaggcaggaggaaaaaatatcttgactttattttaggaacgagtcagaagttatttgtaacatttagtagggtggaggaagagagagaagttccatttttcatttctgaagatgcagctgctagtgctagcctgacgcatggtccataattctacagaaagagtggatgagaatgagtttgtcaatacctaacttttaagtaacttggagtatattgtttatcctttaatatgtggagggaagctaaatctgtttcaacacatgaataagtggttgataaatacatgaaaactgcaatacacaaagctgtgaacagaattgcaaaaagctggtggccagcaatacaattcaatgatgacaaatgactgttttccaaagagattttcttcctggaaggtgaaaactgatggcaaacaaatcaaggcaataactttctccctatcactgagaataactcttacaattatgaaaaacagccatccagaaaacataaaatgctgagatgaattctcctcccacctgtttacctctactccccacagtcacagcaaaaccaatgcccagctaatgtctcagataactccctttcagcatgtggtagacagacaaaactggtaatctttgggcacaatagaaggtagaaagtggtaaggcctgaggagttatttgtcaaaaattattgctctagggtaagataaaacgaacctttccaaaatttctaaaagaaggttttggtagtgaggttgtggcaacaaaggatttgatagatgtgtactcatcagaacatatattttgtatattttttagtttttgtttttcattagtaagtcttcaatcagctactcttacttctgtgtacattcttggacagtcaataccatgcctctttccatattgcaaaactctaatgtaactgtgcaagaaaacacctcccccagttttgaagcagtgagagtaatgtgaagacacggaaacattcattggattgcaattgactcaatgaaacttcctgaaacatcaaaatctcattaaaagcagctattgaataaaaatatcacttaagatacactcaatgatggagtcaggccaaatgtaatttaatactctgtatccagactgggtgtgagaaactgttaactcatcctggtgctatattgccaaaagagttgttctactttagatctatttacttcttggagaaagcctgcaatttgctctgtaagggttccactgtaaatttaaggaagttgtaaagtaaatttctcagtggggagtgctcatcaagctaacagccagtttccagggaataaataaagcctctgaaattgagatgacatcacaaggggaaggcgctttaaacattgtgaacactggctttcagaattgtgattggtcattaatgcctgaaatcacagctgcagtcagtgttttcaaggcagagttactggcagcagcaaggatctatgaaaacacacaccgattggcccaaatttacctttaaagttgaaagaataactcaaaacccaaaagaatctgcctctgacttgaagcagagaaccacaattctcagcaatgcaaccaggaaatgatctactcttattgtattaactttgtatgggcttcttttctctttactatctggttaaatcactagcaatcagtgaagatgagggaaaactcattttctcacatctcttcccttttttaagaaaagctgtaatagggctgaatttcgaatgatttctttttgaggagccaggagagaaatagctatccttttctccacaaactgaagatgtttccttgactaataaatcaattccatagaaaccagagtctagagtcttggagaaatgccttttatagctccagttttttttttaatgtttgatgatactttactctgatttcttatatcatcactaaattattgaattggaacaaacatctgtttacaaatgacacagacctaagtttaattttatgcctagacacagtgagaaaattcaaatatctgaataaaaatggtatgtctcaatattttcagctgtgcattgcctcttaagtattctcatattttatttcatatcttttatgttaccaaagagattatcttagaaataatttattttaatgccctcattgtacatgtaagaaaactatggcccaatgaagttaaactgatttccatgattagaaagataaatggtcaaggacttaagttcctttgattttagcttagtaatcttttcataattataagtaagttctgtcatatttgaaaacaaaacaataaaaccatggaagaacctaagattttccagtgcccacaaatgtagagcaagtatcactcttttatcctaagcaacggcagtctgtagatgaagattacacagtcttgacaaaagctaaaatgaaatggaaaactactacaatcatttggaaatctgacagctagactcattcagtggactatcatcatcagtgaccagattttatacatacatgtatgaatcattcacatacaagcatttcaaatatgacacacatgaatacatatatgcacacatacacaaacatgcatgcatacatatgtatatgttactctcaaactaagctaggagaagtctttgattaggataataaaccattatttgtcgtatttacattttgtatttttcataagcacttaattttgaaattaaaatgtttaattttctaactgttctctgtgacaataaaaaaagattaaaattgagctacaagataaatgtgactatatgacatgtgctcttagaccaggtttccattacaatagcaatgaaagattttagcatttttttgccatgggattcaaataaaatcataaacttaatgagatatttggataatcatttacatgcagtaaaaggaattttaagttttcatctctgtagagaatatgtttaaaatacacaacccacatatacaaacatcaatcactcatcaattattgggactatttatatacaaaaccattttgatgacaatgccattctctgctctggaagagccaggtggtattaaatgcagacaatgggatactggtttcaaaactctgcctcactcctgctgacagcttgaccttacttgatcttatctgtgcaggctatagagaaaaataaccaggacactctgactttgatagctgtttctgtgatgctaattagcagaattgcagaagcgacccaggacaccaggtagggatagcaaagaggggacggagatgatgtcagagtatgttccaaattgtacatttgtaaatattcattttaaagttttcaacattacatgtcattagcattactgcaatgccaaagctcttttgaatactgtctgctctaaggctaacttgtaatgaagagacaaaagtcgctaatcagtctgggatatttcgtggttacctactttgagttcagaagattcttttttgcaaaaggcgaaaggtacttggattatttagaaagctctatttcccttaaaataatcactcagacacttggaagtaatagtaaaaaacgtataattttttccagttcaaattaaattgtctacatacctattagcctctactcacgtattattatctatatgcatccccaaaatatgttaattgtgaaaaatgttaaatggagatataatagttaatatttgtgaatctatttagcattttttcctcactaaatatgtagatacaattcaaattgtaacaaatacactttatttttacattgtgttttatgtgttactaatggatctgcctccataatttcgtttaatgatagcacatgcctgaggaaaaaactttttatccttattttacagatgtgagaaatgagtcataggcaatttaagtgatttgaccagtaaaatgggataacatcttagtaagaggaattaaatcctttctcaacagccatattgttcttgattatgccatatgtcaatagcagaaaaaatgtctatatctaaaagaacaaaggcaaagcattatgaggaacagtccaaaccaaattagtaaacagtgagggagagtaaattatatgtgctaaaagctcttgaaatttcacaccttttattggaaaggtgtagacggaaaaactaggcagaccaggtggttctcaatggagcaattctgcgcacatagatgcattttgaatatttgtaggagtgtttctggttgtcacaatgaggcataacaaaaccacagcctggaatagaagtgggttaagtggtgaccccctaaaagatatgtacatgtcctagaccctggaaccttatttggaaaaaggatctgtggagatgtaattaagtgaaagatcttgaaatgaaatgatcctggattatccagatgggccctaaatccagtgataaatgttcatataagagatatatagaaggaggcagccacacagagaagaggaggagccagtgtgacccaaagcagagattagagtgattctgccacaagccgaggaatgcctggagccaccagaaagctggaagagccaaaaaataaagtttcccctacagggtttagaggccatactgtcccctggattgcagacttttggttccagaactataaaagaataaatttctgttattttaacccactaagcttgtgataatttgttacagtagtcacaggaagtgaacatacaggtatatcccaccttcatatttttgtgtccccccttcactttgcttaccttctttctttagctgttgctatgaatttcctgtctccactcagttatacaatacatttctcactctgccctggggcttctctgctgccacttggacatctctgagaaaccactcagctcagtcattctgatggccttgagtggctaacacacacagaggccacaggtattgcagatctaaggactgcctcagatagaaaaaacaaaaaatctcctgaattcctcaagacattcaaatgctttaggagacattcacatgagcaaaaactctatttgtaattatttgattctataaataacattttttgtacaaatgaaaagtatttgggcaggcttataatagacactgagttttccatgaatatattcatcatgtaaattgggggaagatagattatattctgtttgggctggaacttaactaagaccagttcactattttaaaaaccgtctatgaacaaatttagtgtgttttgttagcaacaatatgcaaattacccataccacacacttgattaatcttcatttgaaactctcacatttatggtcattctgcatataagtgtgagcatctaattacttaattatatcttttaaatattgaagtgcttattattccattataattacttgtcatatgtctcaattatattacagttagatagttatactgagtttttaaattttgatgctggtaagttatgttattttgagtgtaggctggcaggtttatttatttattttctgaaataattgcttttggggacattaaaaatgtttgtaattaaaagggtgtatactggtttgaagaatattaagatttcctgagctaaaacgctatctttcaaggcagacttggtgtccaggtaaactatagactcatccaataatcttcaaggtaccacataagcatagccagaacacatctcatcttgctttataatattaaggttatttttcctcctcctcacctttcccctccattctcctcctcctgctttcctccttctgcttcttcatatcccttgtctcagagaagcttcagctttacagttaaataatcctcttcatcatcacaagatgtttatcgagtatctatcatgttaaaaagcacattctcgaccgggcgcggtcgctcacgcctgtaatcccagcactttgggaggccgaggcgggcggatcacaaggtcaggagatcgagaccattctggctaacacgctgaaaccccgtctccactaaaaatacaaaaaattagccgggcgtggtagcgggcgcctgtaatcccagctgctcaggaggctgaggccagagaatggcgtgaacccgggaggcggagcttgcagtgagccgagatcacgccactgcactccagcctgggcgacagagcgagactccgtctcaactgaaaaaaaaaaaaaagaaagaagaaaaaaagtacattctaaatagactaaagagtataaattcagacttctgtcctcaaaagcttatcaacatgaactgaaaaatatatgcggtatacataaaatatacttaaaatcatgattagctgtgtcaatttcctggctttcttctccagttgatattttgcatgtctttttatgtttttccttggcagtacttgcttagattataacgtcctgaggggttgggatcctatttaaataattctctttgtacagatcctaaaatagcacaatgaagaattagtactttaaaattctttttgatgagggagtgaagctatgcctaaatccctgatagaaatcactactatttccagattacataacagctatatttaaagcttctgaaatagagccattggtaagaactaagattcagtaattcttttgggaaactgcatttttttttagtcacaatccagagaggatattcactcaatagagttattagagttatttagcattgtaatgttaaaatatttgaaaggaaaacggcacaatggcatagtgactcaatggtaatattttatgaatttcgttattatttcatgcatagctactctgtgagtaaagccatcataaatctagtcattgaattactaaggagctcagtggtaccctttgaacaaaatggaagcaaatatctggtagggcaaaggcataatcttccataacttaagataaatatggttatatttggaaaaggacaatagaaaataggaaggaagggtagcagaatattaaaatgagatttttaacttacacagaaaaagtaatgagaatttaaaatggagagtcaataccagaaaagcaacattcaaatttagactctgagttgaggccccattgcaaattcagtggtgaggtaaaatagataaatgactgaaacctcatgggccccttacttgattttagaaagtaagaaagggacttactttaaagattgtgatgacatggctacctattataataataatactctaatacagtggaggaaaataagtgaaattaacatactctgggtctctactttcacaagttacccaagtttaacctcgcaacagtccccaagatagtcagaaagacaacaaataccagttgagacagcaatgagctttacacatacagttaatgttttaaggggctaatacatgcacaacaaaaatgtaatttcccaattctcagagaggaggaaatccaggctaaaccagactaagaagctaccaccaaaccaccagtttgtaaattgaagaaggaagattattaatttgaatacaggcatttatatgagtcttcacactaccttaaacttacaagattgcaaattacttctttgaactttctcccatatcttgaatctccaaccttatttaagtaggtaattgtgaaaggagtttatttaatagttcaagttgctttgttattttcatatggagtacgtaagttattaatattaaaaatatcacaagtagtgaagctttggcagtgaggcatgacaggtcctcagccaggagaagaagggggtttatcgagcatctctgagctctgtctgacatgcccttggcccacatgcttattctcggcaatgagctgtgctggtataacctgacagcactttttcttggctctatcaatcacatgccttttcgggtttctgtgcttaggccttctctactgctatcttttggaatacctgtgggaacccaagcagacatttgaattcacgtatgtgcaaagctgaaagtgcaaggagtttaacactttaaatctcaactaataggagatctgggccagaggataaatactccccttttaatcattttatgtaagcagtctgaggtgcattcaacatggcttctctgaaggtcatcagcaataactccatttgccatccatggaatctttacaacaaccctatgagataaattccgtatctctgtttttaaaatgacaaaactgaagtttagagatgtagagcaaaattccaaaagtcacgcaattttttaatgaagaacatgaggtttgaactacacttattcacagcagaaatgctaaggggatataagacagaggttgagaaagctgcagagacgcctacagggagagaaagagaatcatacgattgaggtacttcaaatacgacgtcttccaatttggaatgatttggagaatatctagatgatgccttctacctacaatctcttatgatattatctaaatttcctccattagatatttgttaggtcttcaagatctgttcaaatgaaaataccttttggaaaaattgctataaatttaatggtaaaaagggctagttgtcagctgtttgagagcaatagctttgaaagagtataatccagtcctaggatataaaaaacacagggaaggaagtgaaattaaaagaggtaaaggagctacaaagtcaaatttcacttttatttattttctttaaggtttgtcctactagtaactataaggaatatgaaatttcaaagcaaaaaaagattaattagtaggaaaccctttttatttaaaaagtcttgaaagtgtgtaaggagcaaagcaatttctaaagcagtgctccatgtttagctttctaagtttagttaggatataaagaaataattatacatctgacttagtcataattgcaccatcttccctctcatgaaaggctacagattatgtaactgcagctattgattttccacatcagacattttaattgaaaggttaagatgaaactggatcagcaaagtttgaggttactaattctgcattaaataatttgggacttgaacgccctcaacagacaagaggctaagaatgttataagaaacattgcacttcttggaaaaggagtattactattaccagttaacagaaaatatttaaagcttggactgaaataaaagacatgaacttcaaataaccttagcttatgagtgggaacgttctgccattattggatttgctgattgtgatatagactactactcaaagcctacttccactttagaactgacatcatttttattgacattgatgttaacatttgaggtatttaagtaaagaagataatgtcagaatgatcatttagtaactattgccatccagaggctgagttcaaaccttaatcctaaaagccctacagaaaaaaaaaaaaaatcaacactcactattcaactgtcaaaaagactgatatccctgaggccattaagtggcaatagtaagcaataacccccatcatcattaagactggaaatcatctaaaaatttatcaacagaaatacaatgatttaaatgcttcagaagaagaaatagattaggtaaattaatatgaaataaaagggactagggaagatcaatatgttactaaatctagaccttgctcagagaacccattgtaaaactccaaatatattacctgtatattgagctaattaatgctacacttgaggcacaaaactacaaattagacatgtaaaactaaatatttacaaggagactttcataaagaattttaattatttttgttaatattttctaagcatatccttcccttttcaggtatggggacatgcataattaattatataaaccttaaaatgtttattatatgttgtagtgaactaatatctaacagttcttagtcatcctgcaagtctgccctgacgacccatcatcatgaaggcattctggatccttctggataaactgaattgggttcccatctctttgctcctactgtgtactgcccacacccaatttcttagggcttaccacattgtttttgaaattgtctacttaaatatcagtctccgccagtaactgggagcataactgagggtggtaaccatgttttctacaacttgctaatactctgttgcctcagcattgctttttagatggctgtatacaacagtagttcttaaacaagtctgagtcccaaattcagagcttaacctgacttatttcccacctaaatttctcagtttttagaatactatttcaatattattaaattagctcattgctttggagtgatattgctgtgacctgtgccaacatagatgttacttctaatagtgctataatgctggaaattgttcaagagtgagaacatgatgaagtggggataagtgccagaaattaatgctgtgtaggtatagccaaaggtggcaaagcctgcatgcggctctttccagcctttaatctgttgtaatggtcaaaacaataaaagagttttcagtggtctgaaggaaaatcattgaagttaaatacatgcatactcatggagtccatctataaaaacatatttgacagaaagaagaggttgggaaatttctttgtagaatggtaatttaaatgcttgacagtttggctaatgtttgcattattcatcacttagtacttgatgaagatacttcactttttatcttgatttcattcctcacttgccctactaaagtatgtatatttcaagtaaagtcagcaaacattaacaatttcaagagctccaaaaattatatcggtaccaacactacataaagtaggttcatactaatgctacattgcacacattcagtgtacgcaatacaacattgcagaaaaagaaagtcaatttgatttttaagctgcaagatattacgctaatatcaaatttcatgtataattgggccattatgctcttaagatacagaaaatacctgaaattttttggagtgctttatttaaccagtgggaattattatttaaataatatacacttctgctttttaaaaacttgctataaataattgtacatttaatcctcttgggatttaatctgttaaaaaaaaaagcatgtttaaaacaagtaaagggcaccaataaataaagttgcattattttaagctaaatgaagtatcgtgctattgaaacaatgaagcactttatcttaaaattccttatttttaatagctagattctctgctcttgatgaaattaaacataatgataatcatttgatacagctaaaatacaatatctctcctctcttagtagaaatagttcaaaatttctagaaaataagttggcaaatattcaaaacacgaagaaattgatgaatgttaaaataaagtaataatcatctttgcaaggtagaatggtttcacgtcctatcgctggaaaccacacacagctgaggatattccaaccttggcatcctttcagaagttatttccatatacttgccaaatcactgggaagtttctattctgaaaatagatcattgtaatatccttagtaagaaggcccattgttgaattaatgccagatttatctgtgctgttaaaattattacccgtattagcacagctattaataatactaccctgtggttttcaaagagctttcatttgtactgcctcatttagttatttcagcaactctgcgaggtaaaaaggactagtattattatccccattgtatatatgggaaattgacacaaaaagaccgaattgacgctacaagttacacaatgggaaactgtgacttacagatcaggaatctttgtaatttaaaaagtagtggaaatatttattaaacatttgttatgggcagtcactttcatctcctaataatagttattgtgaattgtgtgttttctttgtgccagataatttaacaaaccctatctttaaaagttcaaactttcaaagacagatattatcattcccctctttcaggtgagaatgtagtagcccagtggtggcataataaattttaaattcaggtctgtctgacttccaagttcaaggtcttccctctgagatattacttcatttaaatcttacattatcactttgaagtaggtataatgtctctcctttttttttaatttttattttttaaacagacctggaaatgatctaagacagttaatgttacaagaaaagactggttgaagaatcagcattctggctggctgaattttcaatttttgtgattgttgacaatttttaaaaatatataattaaatttcctgccttactaggaagaatacaattagagcaactgtagtttttgttgaagatggtagcctttcaactgctaaggacagtattttaatctcactttgcaaaacatttgtgtaaatattgaaagcagcagatgggcttgaatctgtactgattgtcatatatgactgaatattctttttaaacataaatcattaatgtcaaagagtttttgtgattgtgagatctgggtaattggtgtattattatacccctactgtgagccagatactaagctatagcaaaggggatagacgtatgagcgaattaagcacatgaattagattttacaatactgagagcatcagagttctgaacaggataaaattagatatttaatatattttaggcttagtatgaggaaaaatgctgcactaagctataagcaatttaatatttaatcatagcataaagaaaccacaaacaggaaagcagtacaacagatttacattatttgttaaatataaaataatcatctggatatttttatttgaggctatttatgttatttatgatttaagagtacaatattctgttatgtgtgccaagaagaaggtcagaatattttagagttaagtcaagagttaagatcacagtgattattaatactgttcctaaattgcagtatcatctgttgtagtaacaatattgcaatgaaaggttgaaataaaatactgcatagtttatgtaaataagcacagattttgttttgtgtaataagcaaactgttttcagaaaacactattttaaatagacaaattgttgttagtgtttctttttgtaaacactgcaccaaaaataaaaataaaagccataaatatatggccatatatatatatattttgagactgagtcttgctctgttgcccaggcggaagtgcagtggtggcatccctgctcactgcaacctctgcctctcaggttcaagtcattcttctccctcagcctcctgagtagctgagataacaggcatgtgccaccacacccaactaatctttatatttttagtagagacagggtttcaccatgttggccaggctggtttcaaactcctgacctcaagtgatccacgcatctcagcctcccaaaatgctgggattatgggcatgagccacaacgtccagcccataaacactatattttataaatcacaatcattattgttgaagttttttaaaatattgaattatcttattacttttcccataattaaaaatatacaaatcctagaatgcaatcatagtacaaacttggagaaatcaaataatgtacttttcttctaatgttcagccattacagtggtattctcctgagcagaaaagagcacgtaatttataattattgaggttttcttttatttatgttgataaatgtatttattctggaaagaacattgattaaaaaaaaccacattttatcgttcttccctttgggagtttctttccacagacatctttataattactgttctggttttgacataatacttcaatactaattaagtcgtccaaagaaattcaacgatcatttattgaacaaccactataggcaaggtgctgtggagatctgtaaaaaataaagagatgaaggacatcacaacttgtcttcaaggagttaaatttcctgaggaatctagaacaaattcagcaattgccctaatatatagtgtgttagttctctatcgctcctgtaacaaattaccacaaatttagtgactaaaaagaacacaaattaatatcttaagttgttttggtcagaaggctgaaataggtatcgtggggctgaaatcaagctattgatgcatgagttccttctggaagctccaggaaagaattcacttccttgtcttttcagcttctagaggctgccttcatttcttggtttgtggctcccttccatcttcaaaaccagcaattgcatcactccaatctctgtttccaccatatgtctctcactctgactctccttcctcctttttttttttttaacttataaggtgcttttccattacattaatcccactcaaataatgcaggataacctctccatctcaaaatccttaacttagtcacagctgcaaagtttttttgtccatgtaaaataacatattcacgggttctggggatttgaatgtgtaaatatcttttattagaggtggcattcttctgcctatcacacttgtctaaactatggtgaagccataaataccttacattttagatgtaaacactgacatactcaaaaatccaatatttaagttgttttaacctattcatattaaaacatttaaatattaacagggaagatgataaggccaaaagtttatcatatgcaattaagtaagcaagaaaaatttcccatttcaggtttcaaaagaaataagcaaatctattgataatgcatagattaagtcttagtgaataaatttacatttgtatttttagttcactgttacatatcaaccacctaactgtactttaattttatttgaaaaatcttactatcagaaagcaaaaacaactggacagtagaacttaatttggttctacagaaatttcttgcgctgacttgtaaaacaatgaaatactagttttgaaaaaaataattattaaattatttcataaaaatctttaaatactttataaaatctttttatttcacatatccctctattatcccatttctctgttccttcttaaaacaaaatgacttgaaaaatttttttgaactttctatttccaattttttttctcattctacgtttaacctattttagtcatattttgctcccgttatacggaaacgtaattttagtgaaagtcaccagtgatcaccacactgctaaatcaaagatcaaatcccagtccttattttactggacctctcagtagcattcaaagcagatgattattctctttttgaacttctttcttaatttgacattcagaacctcaactctcttgattttcatactatttcaccattcagtcctcagccacatttacctctcttctttaaccccttaacccgcgatgatggggtgccccagggatcagccttcggatttttacttttctgtgtttcttctactcatcctaagtgagattatctagtcttggggattttactattatttgcatggtatttattcctaaaattttattttcagtctgtatctcttcctggagctccacagtcatttacctaaactccctatttaatatgtccagttggatctccaggagactcataaactcagcatatcctaaactgaatttattatttctgcccccttctcttacaggaacaaaacaaaattgcacaagtaatgttctctatctcagtaaatggcaactctattctggcagatgttcaggcctaaagcattgtaatttaccttgactcttttctgtctcttatatttcataaccaacctgtcagcaaatcctgccgattgtaaacctagttccagaatatgaaccttctcaccacattcattaccaccatttatctctcacttagattatttccctgatttcctaattggtctctctgtttgtgttgcttccctacattacattttcaaatacaatatgcagagtgattctttaaaaatctaagtcaaataatttacctgtgcacaaccttatacaattttcctgactcagtctgagtaaaatccaaagtcaggatagtggcctataaactcctgcattctctggttttctgttacctacctgagctcaactcacaggttttcacatgctctatctccttctggaatgttcttctctcccatgaaggcagggtatttgtctcctttatattttcagtttcagaaatagatgctggcacagtgaaggcactcagtgaatgtttgttaaataggtgaacatattttgtctaaaactaaatgtgaagtaaaatatgttcactacttttcctcttagaaaatctgatgacagcaaaaatgcagagggtttatttttcctgtttgtgtttagtacctgattccaaaggaatttataggctgaacaacagtatgtaaccagtgacttgcctgtatttttcaaattaaggattgacaagtgatagaggtattggggttaaataaatttctgcttctgccagagctcttgtatcagctgtcctcagagttgtctctggtgctttagtaaacaatagagacccattcccactgctttattcactgtcagtctggctgctgctaacagcaaccaggcaggtcctgcttttcgtttgtttgttttatatgtgtattgactttctcaaacatctgaaagctattacaatttgtctttgaatttttctcaaaagttttttctttgtgtttttattacttctactgttataagtacaatattctattaggttgtttgcatcattcaccttctgctgcccaccttctccataagcccaaatataaatgtcttgactacttttcctatttcactcagtattttaaagatgctcaatggtgagtggaaaatgtaatagttaataataattacaataaaatgtctggtaatctcttaattagatatataacaattaaattattagatagttgacaatctatttaagtttatacacacacacacacacacacacacacacacacaaatattcctttctttccaacctcttataaggctggtgattataatgatcccttgattcaagcaaggttcttacagcagaacaagagtaaaagagtcaaatccttgtctctgagatataaaatctaaagttcagccgcaaaagaaacatattttgaaaaacagaggctgctgcaagtattttcacctcctcccaacataaagctcttctgggctagaaagagaggaacttcagtcgggaggtatagttaaagctggtgtaggctccttgagaggaggagtggtgctagaatccttggagaagcttggcttgagtaaaaggcacttgggctcatttccatttgggaccagtgagtcagtaagtcttagagttctatcctcaactacagaggggtaaatcttttacctaagaaattttttttgtttgtttacaacaaaattttttgagcataataaatgcattaaaggtgctatctgatttatctctacaactctgtatgaactgatgagaaaactgaaattcagaaagtttaagaaacctgccaggctgggtgcagtggctcacgcctgtaatcccagcactttgggaggccaaggtgggcagatcacttaaagtcaggagttcaagaccaacctggccaacatgatgaaaccccaccactaccaaaaatacaaaaaattagccgggcatggtggcgggtgcctgtagtcccagctactcgggaggctgaggcagaagaatggcttgaacccgggagatggaggttgcagtgagcagagatagtgacactgcactccagcctgggtaatagagcgagactccatctcaaaaaaaaaagggaacctgcctaaaattgtaccacaagacacaagagagggtgtggtctccacagacagattgccttatgtgaaaccaactccatttcttgtgagttgtgtgccttgggaaagttacttagtgcttttgtgctttctttcttcatctttaatactaacaattatagctatttatatggttcttattattactaaattagttaatacatgtaaagcgctttagtttagtaagtgcttaataaatattggctcttaatttattatgcagcagagttaggagtataaccaagactcatctgactccaacctgtgctttgaacaccgtacatacaggcccatacatacagctgatctcattattataaggactggagaggaatgggatgcagttgaccttcaaaaatagcatctccctgattctagctaagcagggctaattgaggcccaagctgacaggtcagatgtttctttcataaggatgttcctctgtttgactttgcctcctcatttcttcatccttcctatggattaagccatttagaaccaattattcctatgaatacccgtcagaaatctcttgtatttgtgttctctgaagtaagaatgattaaaattataataaaaactctcccactctaccctaaaatgtgttgtaacctggaacacctaaaaatgtgttgttaaccagaatattttccctcagaggtatcacaatgtgcctatgaatatgtaaacttgccttttaaatcaatagctgtgaaaatgtgaagaatatcttgtgaaattaaatggaagtaattgctaacatatttagagtttatgatgaggggagtactgtactaagcagctgacatccaataattcatttaattctatggaagctctataaagcagttgctataatttctcccaatataaagataaaagagtgactcagttttagctcaaacaagcaaagtcatagcatctgagtgttatccaggcagtctgactacagggccctatggcttaaccatgaacctcagaaaattctgttcagacattttctggatgccaggtggtcttatccagcagacaatgccctttatttcataggcatatctctgtagagtgactgattttaacctgattgccccaatgcatgtaaattttaaaatttacacaaggatatattccttccggtgtgactattcctttgcttttgaatatttgctcccgaatataatataagatatggtagaatttataaatattttaagcttctcctgtggccttgtccttttaaatctgtgtatttataatttcaatccaattacttgtttttaacttacatttttgcactaaattctacaggggaatctaaaacacttcagcatttctgaattctgagcaacctgaaaatagggatgtctcaagttatattcttagcttcatcttgctagtggagtaattaaagcacgggtaaaatctgtttaaagtttaatgtaattagcaaagctttggggtaaagtcttactaaattctaacaaataaaatgtatatggattttttttttacttattcttaaaaggtgacaagaaaaattgagttatcagaaaatctaagtctctaaaacttctttacttatttttatcttctcaacttataattctcttgacagtttcttcaattttctaattcagtttatgtacatatgtgcagaacttagacagttacagttacagtggtttcccttcaataggttgggactgtgtttttttctaaaatattctatatcatttcttccatacatattttttaaaagtctctaatttacttttgtattttctccacttagaaatataactgtgataacagaaactttgaaaaaaataatagttgaggttaatgtattgaggattaaaatttctgatccacatttgaggcctgaatattgctttaagtgcagtaaaccattgttgagaactgaaaattattcccattagctaagaaaaaacagaggtaaaccacattaactttctctccacagtcttcagtgaaaatgctttcattgtgcatattttgcttagaaaatgaaccagcttcgttaaatttaaacatcaattgacacgattctatcaattttgcactgattatgaacacttttatagtgaattatttgcacaatagtggatacagagtgccactgtggccttttcagtacgtttgcatggaagccaataagcttactatcaaaaccagagtgaaattcacagttcttatggattttatttttattcttgattctaagaattcaagtatattacttttgtttcgacattgaatctgaactaacaaaggatgaaatgaagcaaaagtgaaatagagttgaaaataaatctaagcagagtaatgtgtgttcaacctatcactactaaagtttgaattctggaaaattaacccattgtattagatcccacttgcatgatataatattgtatatttttacaaaggatgtttgctttcttcattaattctcatttgtctttctgacaattctatgcaacactgtcattcccaataagcctagtgaaatatttccacttgcatcctccaagtcacacctaactggctgcttcttgggtctctcaatttaattcccataatggttaattttaaattcttttatttatttacttaaacactacagttctggaaatgcagtatctccaatcagatcaaagctcttcagtaacaggagaaaattattcaaaattcaatgaatgtttatttagttcttgagataggtcaaacaatgtagtaagaagctgaaaattcatagatgaataagctacccaagaatgttgaaggcaatttgtaagaaggactatagtgtggatgtgcacagagtgttgtggatcacaggggaatgaataaaatctagggctggaaagaggttaagagacatgaaataaaatacaaaacattcaatttatgtttaaattaatgagtagatgcatttctcatgaataaggaggaggaagagacagagaataagaccaggttatgggttttcataaaacatggcctgcttgggaaggagaatagaatagttgtatatggtcacagggtgccagagagggaatagtgggagataatgttagatagatggaaggcagtcagactgggaagggcctaaatatttgtcttttttttttctataatatttgtattttccttgtaggaaatggaaagacattgatctatattacattggcgttttttttaatgaaatatcactgtctttaagaagcagtatcatactctgcacttctaaattagatgccttcttatgtattcccagatttcatagtatgctgtacttagttctaccatagtactcatcatagttttgtaattgtgtatgtgagtgtgtgtgtgtgtgtgtctgtagtctattttaattttttatttaattaatttattcttacagacaggatcttgctctgtcacccaggctggagggcagtggcatcatcacagctcactgtaactttgagctcctgggctcaagaaattctcctgcttcagcctcttgagtagctaggactacaggaacgtgttaccactcccggctaattaattaattcttttttttttttggtagagaaggggtttctgtatgagtgcccaggctggtctcaaactcctcggttcaaggcatcctcctgtctcagccccacaaagtgctaagattacaggcatgggtcactgtgcctggcctatatctgtagtctatactaaactgcaggcttctgtaggacgttgacataccttattctcagttatatgctcattacctagcacttggcttagcccatggtggattcttagtaaatatttggtgaatatattaatcacatttttaagatgagaactctgacatgagtgtcaaggatgcagagaagtgagatgggataatcaaggaaagtgacaaagtatgaatttaaccctgagagattattctgaagtatatgtaatgaatatgctatgctttgttcattataaatagtccagtgtttgaagccttaggttaatttaactagatcattaaaatattagaattttctaactataggcttaagccaagtaagccgtattcaaccacattaaactattttgtcatatagcttatcttctttctttctacggcaacagagatggtactatggggatgatgatattgaatctatatctaatactgtagtctatatcacaggcaaaatcatatttacactatcttgtcttaactttgacagtatgattcagtatccaagccatttctacttatctaggctgccattatattcacgcaagcctttgatagatcaatggaacagggcagcctggtggagcaagaagaaccctgttttaagacagaagtctttaggaaaagtctccatcttgcaattaaactgtcttgtgactttggacaagttatcagagcctggagctaatgcttctggtttcaaattttagcagatataagtgaagtaaagtatacaaagtctctagtacaataactggcatagtggaatttttaggctcctccctggtcacctccctgagtttcttcacttactaaagtaggaggtttagtggcagtcatttctgatgtcatcatgagtgtatgattctattacgatgaattataaaactagttgtttacacttcacaatagggtagacaattgtctctcaaatatggcagaacatttaaaaggtgaaactgaacaaagttttctaacactggatttttaaaaggcttactatttttaatgcatttctaaaaaagaagtcccttactactagcattaccttctgggaaacaacagcaataaaaaaagaattggaagaataatacaatcgctttttcctatccataaatgaatgaatgatgcagcgcttctagaactgaaaagcatttgagagccatgcttagcttgaaatctttttagaattatttagccttatttctaaggaagagtcacttttattttttacatatgactacttccatcttttataaaaatagaagagactgaaaatgactgtcttctataaccctatgctgtaaaggcctagaggggattgagaaaagaagtaaaaactgcttgaaatggtttgatataaaatgtcatttttttctaaaatgattctgacttgtctttcgaatattttgaatgaaacagaaaagaactagcttcctattaatctagaatatagattttttatcattcttaaaaaaataatccattcaaacatttcttggcaatatggaggaagacttgtcacatcactcgaaattttctttaagaagccttgtctcataaagtcagtcaatctcttaagatttgaagaataatgattatctggtaagaagataatcaggttaaagctagcagcactatggaaaattttctttcttgagtctgaaaggactgtttggcttttctaaagcctaaggtcttgttcccaaacctccttactttaaagccaagttaatgaaatatattaactactatcacttagtcattatgctaaatattaacattttaataatatactgtttttgcaaaagcaagtatatatatatgtataattatacaatttttcacttttattatatttattttaaatatttaaagttttaatataatattctaaaaatattataaatattttttctatatataagaaaaagtggaaaaacacataccagactattggtggtggtagattcacagagaatatatggtacaggaagttttctttctatgctatatctcttgaatttttgataaaaacataaatatctttggtaattaggaaatatttcctaacaaaattagtagatgaacatatgaagagaatgatatgtcaaagagaaggtataaaccccattaagataggctctgtttctgtcttgttgaggattgtatttcacagtgcctgcctcacagaaggcacttaataaatattttttgaatgaatgaatcaaaacattaaagaagctgccgcaactaatttacaagctgtctttagagaccacatgaaatctttcttcatatgggaacatttgcattgttagactaggataatacatctttgaccactgccgtgggaatacatgccttggaaatactttcaggtgcaagtctttggaaatatagtcattcagcgagaaacaaacaaacaaaaagtgtgttcattatgtttgctagaatggctctttttgtaggattatagaggtttattgtgcatgacttaacacattttgaatttggcaagatctacaaaatgagagaaatagatcctgactccttcttatctacttgtgtcttcttttactaagagagtgttttactggcagtctacccagtaacactagcacagaattcatatttccttttactttcattcataagcacttttccactttctaacagagaacttgagaaaactcattaagtcttagaatttcactcattcctggtgaacaaaataaagtttcttccttcacagagattctaagggtgtgataaggggtaatattttccttagatatgtctacaacaactatagatgcagcagcaactactatgtcctgaagacctactatgtgtttggcactacatacactttctaatgtagtttttctaaaaaccttttaagttaggcatttttatattcatttttagagggtgaaactgaggctcagagatattaaatgtactcaaaagaggcttgtattaaaatgacttgcctgagactcaattctggtaggtctggatctaaggatgtttgatgctgtggctgttttgttttgcaactttcctataatccattgttcttacggcttcacttgagagctgccccttctatgtaaagagcatgcatagcctgggaaattctgatgaaaattagagtacaaccctgaaatgccagaacttggattgcactcaaactgtcacatgctttctagctatgataaatgggactgaactcattagtgatggatttctagcagcagcaattgcacaggtaaaacttcttaactaagcagatattcaatcattctggcactgtaaaatgtcataagtgctctcagtgtaatcatctttttgtttctttgctacatttggatgagtaaaatcaggaagcattagaatactgctaagtccttccaaaagtataggccaaatgcagaggtattttgggaaacccacttcttgtgtcatactaagctttcttggatcttgattatttaatgccaaaagtgctagttgaattacagtcttgtacacttgaatgcagaagagtaagtggactcagctcttggtggaagtatacctttatttcctttctccccactctggcagatcctcatctatctctatctctcgggctccaggagtttggcactttgccacccaattagctcctgagacagcataatgaaagttaatggacctccaattcaggtaattcacatgaattaaaaataacttaggaaagcatttagggccctataaaatcaaatttagaatactacatttagaggtcataatagtccagttcaaactttctgccacacaaaataaattaaatttatttgaaatatctaaaaattattaaagtcagagagaatagaatttttccaagtcttttgcaaaataaataatcccagtaatgttttcttgcttgattagttctaaatgttttaagatctgatttaaagattgcttacacattttaaagtacatgtagaaaagacttgtagcatataataaacttacataaattattttataatttctaaaattctataaaaattatggtccaatatagaatatagactatagaggaaaagggtagtatttgtgcagaaaccacataaattatatgatagatgaaagagaatgaaaagggaccttgaatttgctttagaagaggcataataaacttactgctggaaaccgtttaatcctttcctttgttacagattgagcttcacttaaaccaacccagagggactgctgaaatctcttcaggagctaaatttttcaattccacaaatatttattaaactaggcattatgaattcaaatatagaggtcagtaatgtgctgtcctatccttaagtaatctacagtttagttattagataaggcaagtactggcatcttacagtgcaaggaagaatataatagtggccataggcaaagcacaaaatactctgtgagtttttttgaaaggaaactaaatcatgttgaagtctgcatggtagagtgagaaaatataaaactgaggtttaaatatggtttttccaccttctaattttgggtcctaggaaattaaacttttggagctttagcttcttttgaataaaatgcacttcataagtgttttttacaagattttctcattatatgtttattaattcatgaagaagtatgtactgattgttaactgtttgcctggttctatagctgtacagtgtatagtatagttgggtagcaaaagtatggtaggtgctatgataaaatggatatgcagattatagcagggctttaaagaaaagtgtagtcactactactcaagggagatccagaatctcttgtagaggagctgccgttatgatctttcctttgcagatgagaaattgaaagctaagaacatttgaataattttacccagggtggacagttactaagtggctgagccaggagccagggctccagcatttttacatgaggcaatcaattctgtgttagctttgaaaaggattatcaaaataatgggacctaaaggaatcatttacatcaatgggaatgtgcatacctcaatatctcagagcattttaaagaaattgatattttgcctagcaattatttttaaaattaatggtgacatatactcactcatataactgttatgcaaagcaggcttttgaatagtatgtggaaatatttaagaagtcttctagtttcaggttactttcaaagagtttttgtttccaagccatctcaatggaagtaaaataaactgtctctgtagttcaataataagctctcatgacctcaccaaactcatatttttatcctatgtcaaggcactattcttttgtacaaatgcataaggccaaaaaattgtttttttctcattacttaggacattcatataaattaatcctctcaaaggggagaaatctatcttgtactttctcattcctccctgctttcccattgctcttgtagagggtgggaaataaatgctggtgacactttcccctgccatttgaaggcactgctatcccatggtatagctgctgaggaattgctagaattgatcttatagtaagtgactctcagtaagtgcctttgtcattgtcttcctccctttgcctccactgtggatgcaataatggttcatgtattactgcatgagcaatcacaaagagaatatacagcaaagtccaagttagtgtttacacagaaaatgagaatagggtgcccatagctatactgagcagatgcctgattattaatgggaagtgggagaagatagaaggctcctcatgctttccagaatccacaggtgttttgacttgtgtcaccaatatagctgtggggagctcatcaatatcatctcctaataataactggcaatccactggggtaacctgaattttccatcttacaggcacaagaatctttctgtagctttgtgggtagccagataaatggaatcaaaatacttatggcaatttatctttgacaaaaaggcaacagggcagcacatcacccgggacacactcatcttgttctcacatgatcaactaaaggtgacctacaataatgaaataattgtttattatagggcatgaatgtattaaataagttggagaatctcatggcaaaatatgcatggctctggattattttacttaagatgaagataaaaagtgtagagtgtgattttttccccctgctatactgtaaggctttattttttcttttgtggaaatactatattctctgtattgactaattgactagttgcagtggtttttaaactttagtgttcccaagaactttctggaatcatgtttaaattgaaattggtgggttcatcttcagatattctaattcagtaagattatagtgagacccaggagtaagcattttaaaagtggatttagactgagaaaagtattacataaaatgaatgactggatgcagccaggagaaatagctcctaccaatagaccacgacattgggaagacaggcacactatgagcagatcttcggaggaaaggcattgagggtggatagagggaggacatagacactgggctgaagggggaggaagctgggaaccctgcacagggctattgaacactgggactcattcctaaaccctggtgacactgtgggaagagaaacaaacccagtcaactgaatccaccttataccacagtgaaatccctaacggcatgacagaagataaaagcaaagcaaagcaaaacaaaacaaaacaaaaaacatggaaagaatagcaactccagagactgaaagaacatcaacccacacagatgacaaagaaccagcataataactctggtaactcaaaaatccagcgtgtcttgttatctccaaatgaccacactagttcaccagcaatggttcttaatatggctgaaatgacagaaatagaactcataatatggatagaaacaaagatcatcaacattcaagggaaagtcaaaacccaatccaaggaatctaaagaatgcaataaaacaatacaagaggccgggcatggtggctcacacctgtaatcccagcactctgggaggctgaggtgggcagatcacgaggtcaggagattgagaccatcccggctaacacgatgaaacccatctctactaaaaatacaaaaaattagccaggcattgtggcgggcacctgtagtcccagctacttgggaggctgaggcaggagaatggcatgaacccgggaggcggagcttgcagtgagctgagatcacgccactgcactccagcctgggtgacagagtgagactccatctcaaaaaaaaaaaaaaaaaaaaaaaaaaaagagaaaaaagatgaaatgggaattttgagaaagaaacaaactagtctgatagagctgaaaaactcacatcaataatttcagaatacgatcacaagtattaacagcagaatcaaccaaactgacgaaagaatctcagagctcaaaaactggttctctaaaataactcagttagacaaaaataaagaaaaatcaaacgaagaagaatgaaccaaacctccaagaaatatggaactatgtaacgagaccaaatcaatgattcattggcatccctgaaaaaaagggaaagaaagcaagcaacttagaaagcatatgataatattgtccatgaaaatgtcctcgacctcaatagagtagctaacattcaaatttagaaaatgcagagaacccttgtgaggtgttatagaagacaaccatctctaaggcacataatcaccagattctccaagatccaaatgaaagaaaaaatgttaaaggcagctagatagaaggggcaggtcacctacaaagggaaccccatcaggctaacagtggaactttcaacagaaaccctacaagcaagaagagactgggggcctatatacagcattcttaaagaaaaaaaaaatccgaagaagaattttgtatcaggccaaactaagctttataagcgaagaagaaataaaatccttttcagacaagcaaatgctaagggacttcattaacacctgacctgccttgcaggaggtccttaagggagtatttaatatggaaaggaaagaccattactgactgtgacaaaaatcacatgtaaatagattaactattgatactataaagcaatcatacaatcatgtctgcataataaccagttaaaaacataatgtcaggatcaaatctgcacatatgaatattaaccttgaatgcaaacaggctaaatgttccaattgaaagacatagaaaggctagttgtaaaaagaagcaagacccaatggtctgctgtcttcaagagacacatctctcatgtgatgatactcacagcctcaaataaagggtggagaaaaatctacaaagctaattaaaaaaattaaacaaaacaaagaacatgggttgctattctaacctcagaatagtctttaaaccaacaataatcagaaaaggcaaagaagggcattgcataattgtaaggggttcaattcaacaagaagagttggctatcctaaatatatgtgcacatatatacacacagcacccagattcataaagcaagttcttagagatctatgaagagactaagataactatagcataacagtgggaaatttaaacatcttactgaccatgttagacagatcatgaagttaaaaaactaacaaagatattcagaacctgaacttgacacttgaccaaataggcttaacagacatctacagactctacctaaaaacaacaaaatatacagtcttctcatctgcacatagcatatattctaaaatcaaccatgcattcagccataaaacagtcctcagtaaattaaaaaaaaacaaaatcacaccaaaacactttttgacctcaacacaataaaaacagaaatcaatactaagaaaaccactcaaactcatgcaattacagggaaattaaacaacatatacccgaatgactttggggtaaggaataaaattaaggcagaaatcaagaaattatttgaaactaatgagaccaaagatacaacataccagaatctctgagacactgctaaactggtattaagagggggagtttatggcattaaatgcccacataaaaaagttagaaagacctcaaattaacgacctaacatcacacctagaggaactagagaaacaagagcaaacccaccccaaaggtagcagaagacaagaaaaaaccaaaatcagagctgaactgaaggaggttgatcttttgtataaaaaaaaatacaagacatcaacgaatctaggagtttgttttttgaaagaataaataagattgatagaccactaactagactaatgaagaaaaaaaaagaagatcgaaataaatgcaaggagaaattacaaagggaacattactactgaacctagagaaataaaaaaaaaaatcatcagagactactgtgaacacctctatgcacacaactagaaaacctagaagcaacagataaatttaaggaaacatacaatctcccaagattgaatcaggaagaaattgaatccatgaactgaccaataatgagttccaaaattgaatcagtaataaaaagcctaccaatcagaaaaacacgagaatcagatggaatcatagctgaattccactagatgtataaagaagagctgctaccattcctactaaaactattccaagaaattgaggtatagggattcctccctaacttattttacaaggccagcatcatcctgataccaaaacctggcagagatgcaacacaaaaagaaaactacagggaagtattttttatgaacatagatgcaaaatttctcaacaaaaataccagcaaactgaatcaaacagcacatctaaaagcaaatctaccatgatcaggtagactttaaccctaggatacaagattaaacatacacaaatccataaatgtgattcatctcataaatagaatttaaaacaaaaaccacatgatcaccttaatagatggataaaaggctttcaataaaattcaacgtccctttgtgttaagaaccctcaacaaactaggcattaaaagaacatgcctcaaaataataagaaccatctatgacaaacccatagccaatatcattctgaatgggcaaaagctggaacattccccttaagaaatgaaataagataaggaggcccactctaaccactcctatacagcatagtactggaagtcctagccagggcaatcaggcaaaagaaaaatgtgaagtgcatcagagaaatagagaaactcaaactatctcagtttgcagatgatgattctctacttagtaaaccctatagtctttgccaacaagctcctacgtctgacaaacaacttcaacagtttcaggatacaaaatcaatgtacagaaatcagtagaatttctatacaccaacaatgtctaagctgagatccaaacgaaaaatgcaaccctcttacaatagccacaaaaagaataaaacacctaggactacagctaaccagggaaatgtaagatctacacaatgagaattacaaagccctgctcaaagaaatcagagataacacaaacaaatggaaaaacattccatactcatggaaccaatattgatagaaagaccatactgccaaaacctgtttacagattcaatgctattcttatcaaggtaccaacaacattcttcacagaattagaaaaaatgattttaaagtttatatgaaacccaaaaaagaccttgaatacccatggcaatcttaagcaaaaggaacaaatctggaggcatcacgttacccaacttgaaataatactgcaatgctagagtaatcaaaacagcatggtactggtacaaaatcagacacatagaccaatgcaacagaatagagaccccagaaataaagctgcgcacctacaaccatctgatctttgacaaagtcgacaaaagcaagcaatggagaaatggctccatattcaataaatggtgctgctggtggtataagtgtttagccacatgccgaagagtgaaactggaccccttccgtacatcatatatgaaaatcaactcaagatgtattaaagacataaatgtaaaacttaaaagtataaaaattctggaagttaacctgggaaataccatttgggacataggccctgacaaagatttcatgatgaaggcaccaaaagcaattgcaacaaaaacaaaaactgacaaatgggacctaattaaactaaagagcttctgcacaacaaaagtgtttactcttcccaatcagagtgatccccaaaatccttaaagggcttgcaagggctacatgctttttaccccacccactcatacatcactgactgcatttcttaccggtctgctcctgtatccgtctattccagctgaagtgacatttttgctgttcataaaacaatacaaacatgctccagtgtgagtctttggcgttctctgttctttcttcctgaaatgctccaacccagatgacatggtttggctgtgtcccaacctaaatctcgtctttaattcccacatgttgtgggagggccccggtgggaggtaattgaatcatggcggccggtctttctcgtgctgtacttatgacagtgaataagtcccacaagacctgatggttttataagaaggagtttctctgcacaagctctctatttgtctgctgccatgcatgtaagacgtgacttgctcctccttgccttctgccatgcttttgaggccaccccagccacatgaaactgtatgtccattaaacctctttttcctcccagtctcaggtatgcttttaaaagcagcatgaaaataaactaatacatcagatataccaaagttcacttttacattttcttcatatctcaaatactttcttatcaaaggtatctcctgaccaccctatacatatacaacatctggttctccttaattgcattatcattattctaatcacttattcatcccttacatattatagatttttcttgtttacttccatattggttgtttctgcccactagaatgtaaacacctcaagggcaggattttatgagctctatttattgctttcccttgagctttctgaacactttggcatttagcaatggctcaataaatatttattgcatgatgctcttcttgctttctgttgtgagatatagcaaatttaacgtagaaatcaaatatttttcattgtaacttattaacaaattacttcaatactcttcagaaccatgctttctttcctcaatatttgtttaacatcctttatcagagatataattcctaaacaaatagggcccactattgtgctttctatttcgctgagccctctctctataatctattgctatttgtgcaatcttttacacataggcaaccctagcacaatccatgacctgaaacaccagtgtaaactagaacaggactttacctctgagtttctatcctggtgaatctttgggggatactccaagtttttctagtcccctgaaatgcatgcatgagtccttaggagaccatgaacacattctccactttcgccttctttagcttatctttgctgccttctgatgttctaccttgtgccccgttatttacctggccaccagatggtgacataattattgctattcccaccaagatcattagcacaaatgtctcttaaagttatgcacatcatagcacaggctgcttttgcaaggaaaggagagaagctttggctcacttgtgttaaaagttattggggttcctgctgagctttcccatttgctcagttttgtgtattgcttcctggcacatactagagggatctgttaggcccactccctcagtttcttacagctgcctctctcaaggtatttgtaacaagtccccccgaggcctgggaaaattggagtgtctctatcaagtattcacccaaatcatcttcccatgctgagaatcaacatgtttgctaggataaatcccagatggtttgtgtgtctctatctagggcaaatttcccacccacctggagtccttgttgagagactgggactgaagagaggcagtggctctttctttctcttttttgttccatagtcttaatttcagtatcttttataaattctcatgctaatgtgtaatgtaggtctcacttggtaaaatccctgcaatgcttaaaaaaaaatccataaaaaacattcattagaaaataagctatttcacaactagcacaaacaccatccagtgctacagacaggtgaagagaaagattgtaactcatatactaaacttcataagttttattccccagaaactaacgtcgcttgcgtttctacttgttgtttgcttaagcacttctttggtaactaaacttggatggcaaaatgttaatgtgtaggaaagtaaatggctaaacataatttatatcagaatggtattttgaaagtggcttttttttaattcatgtgttcatccaacaaacatgttcattgctcattagtggtcagatgtgttgagcccacagagatgaatatacacagtgtgtgccctcaaggactaacaatagtagatataaaaatctaaatcactctctgtaagaggcttatggacaaacttgagtgtgtcttcataaatgtgatgatactgttgaggctctttggaacacctgagagagaagataacattctggaggcccaggatacttgtcttcaaggaattgaaagtctatcatatggacaaaggagtagactcaatgtgtgtggcttcagaagggaaaattaaagcgatgcaggattgaggacattgaggaaaaacatgtaccaagtagactgtttagaaaatatgggctaccttcagaggagcaaagtggtggaagttttaaacaattgtaagggaagtcttttgtttttgcttgttttttgttggtgagaggttatacttacattgtttttagggtattttgagtgatcaaactttatgatattatcatagcctctacccacacagtgcttatccttccattatattattttcatctagttcataaatcagtaatcagaaaagagcattaattcagaacctataaaattatggtgaaaaaatataacaatttcacattttcatctcaatttgatttaaagttcatagttatttactaatgaatgtgggaattcatatgggccagtaggagtgtaatagacatagtctgagtgtgtttgtgatgggcaagtgcatgcattctccctaatattctgaagggagaagttatagagagatgtttccagccagtaatatagaacagtgatactgggtcagtaaaaaactgatgaaaaaaagtggaactttagaatattttcttgtttcttgagtttgactgatttttcagaaccacaatagagctgtgctattctcaggatccatgtgctatggaaatgttttggaacatttttttttttttttggctctgcattcaggttcttctcacatccctctctttttgagctttgaaaaaaaatctaggccttgattttttaaaatttttatctatctatctttctaatctattatctatctttctaatctattatctatctttcaatcatctatctctgtctacctaatatatcatctgtctatctatctatgtatctatctatctatcatctatctacatttgtgctacagcaagtcccagctatgatggaggcaaatatgggtatgtgtggtgggtggagtcaggtgtcacacattccttgatattccccaaactgtaactacccagctatatatatatatccagttttatatatatatatatctttgtatatatagctttgtatatatatgtatgtatatatattcatttgtgtgtatatatatacacacaaatgtatatgtatagcttaactatgtagctatatccaaatacatatttatgtctatacctaatttatttaaatctaactgaatccaactatctcactatccaagcctaagaaattggcactgaaaagtgatatttgaggttacaacacagtgtcttatttcctgaatctgtactggtggatacatttgtaccctggggaacaataggctgtaggtaaaatgcaaggagttgcttcattaaattttgcagcattgtgaggctaaaggaacccttctggaccatcataagagaaggaagtgtgttgtttcccattttacttcacagaaaagtgcgaagtgtgatggcaccagcagattggaagcacaggtccccaaggtttgacggaggtccatccgagaacagagcaaataaagatcaaccacggcagtggcagagttactggcacctaggtcctgtggattgtccaggcaaggcccaaattgcagcattacagcagggagactgaaaagcagcagtataataatggcagtcgtggctcagggtgtggctcagcagggaagggtagaacagttggttttcctggatggaatttctgaatgtgggaatctcccaggggtctcctggcaatatgccagcagagaggtcatttttaaaggtagaactgagagattatagttatattctttgcggaaaataagttcatgaatgtgacctcattcatgtccatgaatgaagctggtgagacagtacaattttaagttatttctgttaccctacttagttatgatattgactaaagatgaggtaataaaaggaagggaaatctagagacatcacaaaattaaaattgtagaaacattttaaagaattttaaaaagcatatgacatttcagaaattataatcagaggttgcttacattttaactcaggtatctctttatccttgctaagggaagatgtaagtagcctctgctaaaactgaagcacagcctaggttcaaacaagtggggcattgatattagccgcttctcaaggcagctgtgtagtaactccaggctgtcagaaagagttatcagatagaagaccatgctcttaaaaagataccagtaaaactaacttacgtaaaacactttgtaatctacaaacctcatttattcatcatctcatttattattcataataaagccttttcaagaaaatgtttttatcccaattttgtaaatgaggaagcaaggttcagagatatgaaaacacaccctaggacgaagggattttgaacttaagtatttggattctaattacaactgtctagctataagtataaaagcccagagtgcatcttaatcattttggggtaatggaatatttgagaatcaaaagaaagtggtaaaccctcgccccagaatagctacatagatatacacatatacaaaattcaaatattctttcagaaacacttctgaaacatattcagggatatgctacatgtctaaagaccacagaatgaaaaatctaggctgaaagtggaatattggggtgctgtaacaatcaggtttaataactgaagagtttatgtgaaaaagcaaactcaagaaatttaattttgtaattgcagtcttatgttttgggtcccatggtgatattactaagggttttctcctaatataattcatatattcatactgggggaaaaggtttctgtaaatgtagttcttatttcccttctgtatgtttctaagacacctctttgtatttctctattcctgtagcagtaattcacatcattgttatatagaacagtactttacagttctattattttatgtacctgctaaggttttttcaattactactagacaattgcctgtcctaattggtagccatgaggtgaactgatctttgatgcatgtggtatacaatatgagggctgttcacttatttttctcccacagttaatgaataagttactggagagtgacatttgaataatagcattgcattaagagaagccaaatttccattcttgctttgttcttacaaaaacagagggaaaataaatcaagaatgacctttagccttttagcaattagatcataattttttctttggttactaacggtgactcctgagagtcactatttacaattctatttatttcattttaccttagagttgaatgatttatgaatgtctgagctcagatgcatacaggactaacaaaactcagctttctcgtctcctgtctgctaacaggataatggggcatcgtgatggtcttttagatgtgtgaacttggctagggtatagcctctagttagtctttcaagcataaatctaggtattgctgtgaaagttattttataaattgtattaatgttcataaaaattgacatttagtaaggcagactgtcttaaataatccggatgagcctgaatcaattggctgatgaaccttaaaattagagatgagggtttcttgaaaaagaagaaatgccacctgtggacagcggcttcagcctgggctatgagcttcagcatgccctttttgatagcttgtcctacagatttcaaatttgtctagccagccccacaattttgtaagacagttatttgcaataaatatcttacatacctcctatcacttctgcttttttggttgtccatttactggcacaaacgtatatgcaaatatcaattgagttaaagcaataacttcaggtacctccttatttctcaaaaaatatacaagttaaacacaaggagttaccctgaattagagagaaacgtgatgattctcttgaagatttcaaaacattgaactagtctagatcagaatgttgctattctagatgtactgttatctattattttaacttaatttgccaatatattaattatcagctttagctggaatgttttcttaaataaaaatgtatagatgtatgtatctatatatttatagttcacctattatctatccacatctctaataccattaagtgtgtatttgcacaggtatatctaaaggaggattactgctgttattgtatattggtatatttaataacatcatatctgattaaattcataaaactctagaaatccaatagcctcttattaatattctgtttctgattgaaataaaaatgtttgcttcttgcaacattgcctaataacttatgataaaataaccccaaaagaatattccgttgaaagttgtattcccactatatatatatccatatctaggttgtatatatttttatatatatatatagtgggaatacatatatatacatatataatatatacacatacatagcagtaactagattactgatggaccaatgatgttaaataatctgtgcctacttctatgttatattttattatcacatataaattatgtttaattattgccaatgcctaggaaagtaacctctgaaaattaagagcttactttacattaaggtcaagttaccacagaccagaacatacactaaaatttacacctaaaggctctaatcctgcaagaattgcatatgacttcattgtaataataatccagaggagggatgcagaaaatgaaaagtggtagttggtcaggaaagataaaggaaagagccagagacaaatttcaatagtgcctattcaagcagtgcttaaaggaggggcttaactcctggagaaaaccattcctaacctagatatggataaatctaactctcctcattttgattccacatgtgcacctgcccatcttccttcattcatcaatctgagacattcaacctgccattaatagtacctggacgccaggtgcagtggctcatgcctgtaatcccagcactttgggagtccgaggtgtgcagatcacctgagggtaaggagttgaaaccaggctggtcaacatggcgaaaccccatctctactaaaaatacaaaaattagccgggcatggtggtgggagcctgtaatcccagctactcaggaggctgaggcaggagaattgcttgaacccagaagccagaggttgcagtgagccaagattgccccactgcactccagcctgggcgacagagtgagactccacctcaaaaaaaaaaaaaagttcctgggcatgtgccattgtgaggaaattaccagatgccagagaagatgctcagtattatttgtcattgggaaacagaaattgaaactacaatgatataccactacacacatttagaatacataaaattataaagattgacaatatcaagttttggcaagaatgtagaaaaactggaactctcatacactgcttggaaacagtttgggagtttcttaaataaataaatatacatataccatattagatagccatttcacttctaggtatttatccaagagaaatgaaagtccaatacaaaagacatgtacataaatgtttacatcagctttatttgtaatgaccaatgatgaaaacaactcaaatgtctatcaaaaggtgaatgaataaacgaatgtgatacgttcatacaatgatgtactattcagtaataagaaggaatgaactattgatatacacaacaatatgagtgaatctgaaaataatgctgagtgaaaaagccagacataaagagtatatatggtatgattccatttatctaagattctagaaaatataaactaattatagttgcaggaagcaggtcagtggtttctgtgggaggagggttaggaagaaatgggaggaagagattacaaagggaaaattggagtggtgatagattttttttttatattggtgatagttttatgagttaatacatatgttgaaatttataaaacataaaactgtacacttatcttaattttttttgaaataaaaataaaaatctgctgggcacagtggctcacgcctataatcatagcactttgaaaggccaaggtaggaggattgcttgagaccaagagtttgagatcagcctaggcagcatagtgagacaccttctatagtaaaagaaatgtgttatcccaataaagttattgggatataattgacaaaacagaaacaacaaacacaacagcaacaattaaaatttttttaaaaagagcataaataaatattgttattataatgattataatgaggtgaatgtatttcctgttgataatgttgaggcagggacatggcaagagtctgaatgttttaaaaatggaatcatgtgccaaaaatgttgtcttgtgagaatgctgttactgagactatcatttcagaaaatgcctgaggttagcgtgttcctagcactagcatcaaacctccacttgggtgccttggtcagcagcattcttaagtttgcagatcactgagaaatactgcagaaggtaaaagagaaaagcagtgtaaaaatgactgcttagacatttctctaatcagaatccaatttgattcaatatctgtcaaatgataaataatgaattaattttctctgcaaatgtgaatatgttaatgacacaaataacacttatgtgttagacataatttatttgagtatcacgagaatcctttgaaaatctagagacaaagatatgtgacttgaacaacagaagtggttttcaaagttgttaagcaagtcagaatgttaagactttatctggttccaaccctttaaataaacaggcaagcaagtaagtacctaaattatttaaaacttcctatcagaattgcttgatagagtcattcaacatatatttttagcgtacctataatttgaaatgaaaagtcaaaaagacgataagtggcaatcttttactcaattaatgaattatgttcttagtcattcagttatttaggcattaatgtaacactgtttatactgaatatttatattaaatagtgtatcaggcactgccaataatgaagaatgcaaagattaaggatatagctcccatggcccaggaggttctactgaactctataaactttttttagtaaataaaatggaaactttagtagataaaccagccaataaaatctacaatatcatgttgtaggatcgtatattttaaataagtgtatacttacaatgattgaacaagtgaagcataaatacatagtacacagtgaaattaaaaatgcagttattctgttttattgcacatagtgaagtaaaaaacaaaatgccttttggaagataaaattaagtgctttcgttaatgtgaaagaaaatgagaaaattttaagtgagaaaatctggctgattgtctattcagcaatcagacaattgcatggtttcatttttccttgagatgctttgataattatttgctatactttcctaagagaatttctatttcagttttaagcatattcttaaagtttgaaaattataattcttatgaattactttttaaaatgtttagatcattcattttaataccacacaatgcttggtttgttgcaaaaatataattttaaagtttcactctatgatttgaattttaccaggagaaaatcaactggaatatcaaaataatttcatttcctttttgcagttggtgttaactcttcattataaacacagtattcatgtaattatagttgaagagtatatacaagcaaagttcaagtgtggcatctaatttgtagaagttcctagtttgtttagggaggtaagaccaaaaaaatagccatttagaaataaaattgtttctagtttaccaagtgtgttggctcacacctgtaattccagctacttgggaggctgaggagggaggattggttggggctggatttcaagtccagcctggacaacatattgagacatagtaattttcttaaaaaatatttttctaaaaataaagataaagtgtagtatagaattaagtttcaatatgagtgttgcaggtatagaaatgttcataaacttttagtcattgataaaagtgagataatgttccacaatggttcaagtcccaatgccatcacttaataggcatatgattttcggtgagttatttaactgctccacggctctttatatggcatatagataataatagctgctaacttatatgagctttttcaacaagactaaatcaatttctgtattaatttacttagaatgattcctggcacaagtaagagctccatgttgtcaattagtgttatttagtgaaagggaaggtggttgaccaagccaacttttgccaccagtgtgtttgggaaatcttagaggcctggaaattatcacaatagatctgaaaattcaaatgaaaaccaaaagataactggtctaaagattataagcaaattattaaaatagggagatgcaagcctttttaacattgaaacaaggttctcatacttgaaaaaaaatacaattactgataaaacaaaaactaagtatttgaaattaagttgatctagattttaatgtcagttctgtcccttattgtctgtgatactgataataaattgttcaaatcctgtcagccttttttttaacctatgaaatttattacattgattaattggagataatgaatgagcaaattttcagaaaatgagttttcttcccattcttccttcattccttttcttaccaaatcaattatcagagaagatttaaggaagtagatgacactgtctttttatcctgaatatttgtgttaagacttgtatgagagagagagagagagagagttttcgcttaagacttgagtcagatttgtttaggtaattttttttgccaattattttttagtttagtgctaaataaatgttatttggttccttacattattggtgatttctctaaacattcaatgttcacatttcacttttgttttctaaatttttgtctaaataagtctcactgaaacacatttgtgaaaacatacctccattccctgttgcatcaaattgggtactaaaagaactggatgtcaaaacactcagggttttctctttttattctcctctgcgtaaatactgatttcatatctctagttatctttagtaaaatagaaatgagtcttttctcttagcaatgctgtgactatacataatattatgtatttttatatattatatatttatatattttttattgttatagatatatattttatgcttatatataataaaataaaaaacaacaacaaaaaacaaaagcaagcctgccattttcgcacaaactatgcaggaagttaggattgtaaaaaagtgattgctaattatatcttttaatgtcacatataaaaaaagttcttcctatgtatttggaatgaaattatatatcttatattttgcctgtttttaattgtataatatataataacactattccaatcacatctgagttttacaataaatatccagaacttatttcttctcaaatactttttttgcttggtttccaaaacaccactgtttatgttccctccctacctcactgcaagctcctcttcaaccttctttgctggctctttttatcttcttgacctctgaatgctggagtgcttagttcttaggccaagaaagacagaaaggtatttttattttcctgaattcactccctaaatgagttcatgcaatcgtatcatttaaaatatcacgtacatgctgaggtttctcaaaattgtctcatataccttatctcacggtaggtcagcaaatgatattggtgctactctcaaaatcagagccaccctcacactttgacttctattccatctgtacaaatatacattagtatatattccaattttttggacccctacatctctatcttcctattgtctccagagtagcaagagtgacctttttataacaaaagatttgatcaagccattcctctattaaaaagcctctgatacggcctggcgcggtggctcacgcctgtaatcctagcactttgggaggctgaggcgggtggatcacgaggtcaggagatcaagaccatcctggctaacacggggaaaccccgtctctactaaaaatacaaaaaatcagccgggcgtcgtggtgggcacctgtagtcccagctactcgggaggctgaggcacgagaatggcgtaaacccgggaggcggagcttgcagtgagccgagatcgcgccactgcacactccagcctgggcaacagagcaagactccgtctgaaaaaaaaaaaaaaaaagcctctgatgcggagtttgcagtgagccgagatcgtgccactgcactccagcctgggcgacagagtgagactccgtcttaaaaaaaaaaaaaaaaaaaaagaaaaagcctctgatggctgcagtttttactgaggattcaatctaaaatttacttaccatatttaaggccatttgggatctggtctcagctactttcttaatatcatctctgatcactctctaatcgcctagaagtaagttggtctctttggtgttccttgaactcaccaacatggttcaccactaaaaccttttactatctccatcctggaacacccatcctcttgctttcttcacatttctgctcaaatgtcattttaacagaggccaaccatgactttagagtataaaatacgcagaccagctgaaccctttaccctttatcccttgatgtaggtggatttctcaccttaccacacccatattactagtaatagatttatctgctttctttctttttttttttttgagacggagtctcgctctgtcgcccaggctggagtgcagtggcgccatctcggctcactgcaagctccgcctcccgggttcacgccattctcctgcctcagcctcccgagtagctgggactacaagcgcctgccaccactcccggctaatttttttttttggtatttttagtagagacggagtttcaccgtgttagccaggatggtcttgatctcctgacctcgtgatccacccgcctcggcctcccaaagtgctgggattacaggcgtgagccattgcgcgcggccttgtctgtatttttaaaaatttactatctctgtctactagtatcctctataagaacaagggctttgtctgctttattcattgctatattccttacaaaagtgccaagctcggaaaaggaactcaataaatacttattgattgaacaaataaatgaattccacatctgccacttactgcaaacatgggcaagtaatgtaaactctcgatgtcccagtttctctatttgcctagcaaaaaaagaaagaaaatctaacttacatggtctatttaaggttaaatggcactatatgctatggggatacctgagcatgtagtaaatcttaatgaatgatttatattgctttgacagtctagccaggaactgtttggattagcacagatttttagcacttgaattttcctattctaatttatttatgagtccgtttcacctgacaaaaattaatgaccatcacaaacatatattttggaagatcaaatgagataaatacacaatatttgaattagtaattgtgaatgctgtatgataatttataacatttttcactgaagtttgtttgtttatgttgtggtatacaaaggaaaatcaaagtatcaacctacatttttggcaaaatatgttaaatgaaacacaatggtctcattcctatctcaatattcctggtgtatgtagcttagccctcataataaactgaagactgacttaatgaatcattcatgattagtttgaactaatcatcggaatgatcagatgttggcaggggttcctgtaatgaaaggaaatgatctaccatctgtaagtgcctcagaattctgaaggttcttaggttctattttttccctaatacttagtcattttctgtagccatttatcttgaataagccaaaaaaaggaaaggtcagccagattcaagatttcaaaggtgtcatttctttagcaaacatgcactattcttgatagactttgaaatattttgcatctataaaggtttcattcagaatcgtaaattataagatattccagtctttaagataagggagtgttttgagcttgaatcagcaaaaccattcaaactcaactttctttgtttcaaataatgaaaggattgccactgctgaaacaaatattgaattttttcaatttttctatctttataaagaaggtggattgtaaatggaaaggtgttgattgggataatttttcttttaaataaaactaaaatatgtaaatatttaaagtttttcagatgatctgaaaaaacattaccaaatatttagctagttaaaagttacctatctaactatctgattaactttctcactggtacttttgatcaaaagtcactatttattaactgtaccctggctttgctatttaccaccataaacaactgatttgtcttggaaacacatacccagccttcaggacttagttcaagaaagcctgcctctataaagaaagtataatttcttattttctccttttttggactgacttgtttacatataggttttcttggctagtttatagaatccttgagttatttaatcttcttttgttttagtttcctagtactgaatacaattatattttaaagctcagagttatttaatctttagtgttagttacctagtactgaatacaattttattttaaagctcaattatctattttaaagcaacagaaacattttttgtgagtagatggtatatataatgactaatagaatcaatgctagtaaatagattttttgcatctctctgggatgaaataagaaaaagagatgtagtattataaatatatgtaagacatgcatatgtgtatatgtattgcatatgtttataaaggagatatagagttataaacatatccaagacaaaatcttttttctaaaaatattatctaaaaataatgaaactactaagataaataaaatatatatagcaggagatgatacaaccacttaccaatgagcattcattccattgttcattcattcatttatttattcacacaaaggctttggagctaacagtaacaagatcttcctgagctatcttttttaaaaaaaaattgctgcaattaaaaatcaaaaggactctggacatcacaggagactgactactctcatgatctcattcatggtctggagctgcatatttcattatgatagccactagtcttcagtggctattcagcacttgaaatgtgtctagtcttaattgtggggtgctgtaagttttattctacctttaagttttatttcagaaataacatgagtaaaagtacaaaaatgcatgctagtttccaagacttattaatttaaaaatgtaaaacttctcaatatttttattaatgaaacattgaaatgatagcatgtcggacatactgggttaaatgaaatttattaataagcttaatttcacctgattctcaactttttattgtgactactagaatatgtcaaattacatatatggctcacattgtatttctactggacagcagtactctaggaccgagatggcaaactttggcttgtgggcattcgtccctccacctgtttttgtaaataaaattttattggaatacagccccactcatttgttcacatattgttcatgcctgcttttgtgctacactggcagagttgagtagtcacaatagatactgtatagtccacaaagtctaaaatatttatgatttggcactttacagcacaattttaaagactcctacactagatgttgttttctcttgatatctctgcttctctttatctgcctttctgccccttcttgctatgaatcaggcaagcccctttgtaataaccatgttctagaagaaaacagactttttggtttatccaattaccattaatcctgtttgttcagagtatttttgaccaggctgtgttatccaacctatagatcaaatgtttagttcagtccagtaagtgactagctttgggcaaaaaataaacctaatatttttacccttcacatacttttgtgagcaggtagaacaggatgctgggcccagcaggtactgtgacccatgtgtccaacatatttagcacgggctgtattagtccctgggtaaaaaagataagagagtgacaaatatagattcatgttaacaagagacaactagctcagattctgggttatgagggagagtctttaatggaaagctttgaggggaaaggaagcattggttgacagctaagaatgtaaggaaaattattcacatttctgatttattttcttgatctttatgaatcacggtgctaatactttattttaaatggagtttacttgtagtatagattcatatctgagtatcaatattgaaatatgtattctaacataaatttaaaatgacctttgtattatccatttaaaattattttaatgatactaccatatcttttataattaagaactgaccaaattgcccaacaatttaaacagaattataacccaaaagcaaattgcttttctatcttatgtcacagaatgaaataaattaacttgttaactttcattgtaaaaggatttacttcaaatttacatgtaggaatgtataatttcttctacctataagttttatttcagaaataacatgagtaaatgtgcaaagttggctagaacagatggatatatatgactattgtgaaatcaaagtggatttcattctatttctagaaacatgacacactgtttcttgcttgtaatgaacatgtaccctagaatgttttaatttagctttaattttagcttttgataatttcatagctcttctaagaggtgtactcaccttgagtgtcaataataacttttggctaaaagtaataactctactttcaacatttcaaactagatgtgtcacctaaacctgaagataaagtaaattaaaaggcaaataacagtgtttctaatgttttatcaataaattcctttcctcaagaatgaagtccatcctcttttattctatcctagaggaggaggagtggtgattggggttagtcaaaatttaaaacatttaattggctattgtgctaataagtgacattttcaagtgatgttagatagctaagtatgactattttcaatgttgttcctatgagaattgtcttcctcccaattatgctttgggtcaaaatacacagaattttaagtgtatggatatgtgtaacctttctgcacaccaaactcagtttcaacagttttactgctggagagggaaaggctgagccaatcacaccacctggttcattatgaggctatttcagtagacgaagtattatgtaaaataaattctccatatggttcattttggcatgctagaattctacattgaaagtttgtaagatagaatgttaaactgtttttctactatggtacctatatcgtcattggagatccaaagaggaaaaagaagtaattggatttaaggaaggatttaggtaccccctaggtttgctgaacattatcatgatgccagctggaattgggagacagacattaatcacattttaacaaaataatcattcttatccaaggcactatcactctgggctattcttactcaaattatgatatatctaattctttgtaaaagtaagaatttaatgaattgtcaagcctacttgacatctttaacctttcttgcttttttgtggacaaaactttagcgttttaaacaccctcataaacaccatattcgataacctattttcagcactacttgacttctatgtgaaatttatactgctaatgcccatccatcttctacttcttaaagttttcttcgccccatgatttctaagacaattctcacttctgtctattttttctcatctctctggcattagtgttcagttccccttgctgaagtcttcttctaacttgttgaagttcaacacattttggttccttattttcacttctaactatatatattttggaataatctcatttacccaatggtttcaactatctgaaatgtgttgatatctctcagatcaatatcttcagtcttgaatgctatacatagttacatctaattgcttattgcacataccacaggttcctcaaatactatgggtaccaaggagtactttcatgctttccctttaccaccacctccaaagtctactcctattcttgtattctttacctcagttaatggcatcaccatccaccatcaagctacaagtcacagagttattactttattctatttctcagtttatacattactggtcaccaaattctgtcagttttactttatgattttttcttgcatctgtcatatctcaattcaacacaataacaggtttttttttttttttttaaaaaaaacctttacagaattttcttggaattttctcccttcactgttaccaacatttttctataccagtctaaactttacagtgctaccatagcaatcttactaaaaacaaaatctgctgaaaatcctcttctagatatttgattataaaataaaataaaaagcctctaatgtgccacataaaggcctttataatatgtcctgatctactgagttagtccagtctcatctcttattattcattcccacccgtcatcatttgtctttgattccaggtataccatactttccactggacccacaaacatcacctattatttaaaaaaatccatacctttttcaattctgttttcttgctggtaatactccatctaccctcaccttctcttcttaggaaatatctatttctcttccaatattcaaatatcctttttgttctttgacactttgccagagttctaccttcaatgggctagtgaataccttcaacattaaatataaatttggctttaaaaattttgagtctgtaagtataagcttattataagcttattcattttatctagacttactataatgtcaatggaaagcttgatattttgaatagcacttagtagttcttcaaatgtctgttttgaacatttagtaaaaaataaaaacatgtaactacaactggacagatttccccaaacataatctatagggaatgaaagaaagagagatggtatcttttgcatctatttggtttttgactgtcttaactctgtgtccatatattatgacatgatataataactaatgctttattactcctctatcttcctaatcagatcacgaactcctccaagatagagaatgtccatcctaggatctctaatagcagaaacaataaaaaaaaagtggctgtagatcaaactttggataagataacttgataatatcaaaggagaatcatcagagaaaaactcaggaatgctaaagtctcaatctttcttttagttccacaagacctctcttggtattcaatgttcattgagaggccaaataaaaccaattacatagctatggttttaaagacatcatttgggaagggctatgatgagagatacactttttgacttttggagtcagtctcatatctatatggcttaatcccaatgtgtggggattttgtgattgtttgacattttgtccttttcttccccttctttcattagccaaaaactctacaagtcaatttatattttacttactttttaattatccacctttagctcactatccctaaaccaatttgtgctgctggtgttttggattaggatgggatggcaaaaatgggaaaaagctggaaagacaaaagatatttggaaggcaaaatcaagagaaatggaaagggacacaacacaattttcagttaaaacatcacctaaaaatctaaatgttgctaatttcatagccaaatgtgactgaaataataatgtgcatgattggttattgcacaggaattaaataactgctaagttacatgtgctttctttttcttccttgaaatttaagaaaattataaagactagatgttacataagtgaggtctctctgggaagaggctgaataattaggaagtaagagagtaacagtgtggcttcttaaaaggttagagactattaaaattgacaaataaccaattccaagcatcagatatctagcaataataaggaagtgagaatggaaattagagaaactgtagacaatactttcttcctaagtggatttaattctgaaaatatcccaagggatagggagggtgataacataatgcctgcatttaactgacaatcagagcaaaatgtgagtgcacagcagaaagaggtgcagcaactgtggattgtgctatgatttatgtggctaaatgaatgagctgtagagttgctactgcattctgaagacattggcaagtgaatggcttatatcacctattctgtctctaattactgagcctgtaatagctaacccaatttccctgaaacattgaaacttttaaaggcatagcaggaaaaaagccacattatatgctttactcagtactgaagttttgaattacatattaattgtgtccactgtttttattagcttgaaagtttttattaaatttcacatttaaaaatctttgcaatattagaatcttacagattcttcattatttagcccatcataccttttcaactaagtcatttcagttgttcttttctacactgtgaggcagtaggtatgactgatgttattgatcctgttctactaggagaaaataggctcagaaatgtctaatgctattcccaattcatataatttattagtgttgaagtcaacattattccactatttgagagttctgtctacaataccacattgtagatttggggactagcagagcatacagattagctgcatcgtaagtttcttcagaatatgcatgctttttatcatcttaattttagaatgtagaggtgtttgtgatctccaatcaggcgatgaaaagcggatttggagaagacacaagaataatttcctgtataaaatgtatgaacatgagagtggattcttgagttaaagtgatttttttttcctctcaaatagagtgggtatagtctcttaaatgactttatttttaaaagtttatttattttcagttgacaaatgaaacttgtatgttcttatggtatacaaagtgatattatatatatatatatatatatatgattaatgtaattggcatatctgttacctcacatacttatattttgtggtgaaaacatttaaaatctagtttcttagcaattttcaagtatacattattaactatagtcaccatgctgtacaatagatttgcagaacttattcctcctaactaaaactttgtaccctttgaccaacatctccccattccccgcttcccaccccggtcttagcccctggtgttagaaaacaattttagataaaatagttacaaaacttttgaccaggaggtgttctggactacctataaactgcatgtgaggctgcaatgcatgcaggcatatcatttatactgcatcctagttttcaatattacagaataatgttttattgttgaatatgttaaaggtgataaaaatataaagccaaacaagataggtcctagactttggaaaaatacatatttctaaaatgtcaacagattcttctttcctcccctcctttttttttttttttaacttttttactttcactttctaaagctctgttgaatttggaggcataaggatgagaaaagactggcccacaacttgagtgcattgttcactgtgaatcttgataataacaggtatccctcatcaagcacttctacatgacatgcactgtgctcggcttaaaaaacatctacaacaaccttatgcaatgggtatttggatattatcagttcttaatgcagaaaattagtcttagagagatctttaaatttgaatttagatctgttgccgttgggttgcaatactgaaattagacttttaaaaaggctgcagggcaagacagaaaggtgactcaatctccaatgaggctagatagctgctgagtcaagaccgtataaggcagcattaatctatgtaagttccttcaagttcagaatctgttagtgattggacatgacttaactgcaggttgctgatatgtcaaccaaactcacaagaaagtggcatacataataaaaatgcaaatttataatttcccacgagaaatatggcaaatggattaaatattttctttatactgacccctaattatcagaaaataatctgtgtaagaatgcctcatcatataacacgaataataccactgtctgtatccttaagtctctctatagaggataaaagtgtttcttttgcaacacgacacttgcattcttgaaaaaccctgtattctgcaaaactatgtactaaaaataaaattacgaggcttatggaggaaacggggctggggcaaaacctatgtaattgtgtaccaaaagcactagcaaaaacagtggttggtacctagagagattacttgaataacttggaaagagaggtcaagatagctggggtttgcaccatgaaatattataaaggctgaaagcaattgagtggaaatactgacttttaagcactgggacaatgcagaagacagcagaactcagacgcattgtgactgctctttagatgcactctgcagtgactgcaacatgccgggagcttagagcaaggcagggagtgaggagacctgcagagggtaatctaggtcaagggctcattataatttcactctcactattccagctccacttgcctagaagaaattatctataaaaccatacaacatttctgttctactagcattattgctgtatttgccaatcatatgagctacctagtgttacagaagatatattgcaacagagcagtctggctatgttgtcctaacagagtactcttagccctgtgtagttcttgggtgagtattgccaaattgccttattaattctcattttatatttatagatgactgaccactctctcttttgattggcacattcttaggctttataatatcttcagtcagggtatctcaacccctctacagacagaaaggattagagttaactagaactctagagttctgctagtccaactgagaaaaacctcacaatagcatccatcgttaaccactctgcttcaattcttacagagatagaaagttcactgacttctaagatggtccatttattcatctacttataaaaaacacatatgatcataatagttctaacattttgagtgtttagtacttaaataagtcttaagcttaagaataagttgaacagaaagaaaattctgatttagagactatgatgagactatttggataacatatgtaaatgttcaatggctctaggagatgtctttttagatatggcaatttaccataggaatgcttatctatagaactggtaagaaaagataatggggaaaataaaaatttatcagaagtatatttttagaggattaatgacttttgtaaatttctcaagaagttaatgatagattgttgcacataaaagctgaaagagaaactaatttgtaattatatataatgttacatttaatttgtaaatggaaaatttaagttcagtaaacaagatgatcaaagtcatttgtaaattatagtaacatatttaaaatagatactgtatttagtaatctatcaaattttgcattttatatttcattcctagaacttattatataccacatttaaagccttttttgttagtgaaaaagagtagagatattttttattaaaaactttttaaaaatatttaagtctagtaaataaaattaagttagagatagaaaacacctatagaaatccctttcctaatgatacagatccttgacagactaaaggacttatataataaaaagtcatcaatattgttctgatttctaatcttgtagtatttcaaaacagaggagatagcgatttactgcagacagcgaggagagactatgcattagaaataagcaaattatcagaataggtcgcaagataaccaatatgttttcatgactgaaagatataacttatgaagttattcaggacactggacatgaagttttcacaagaggtaagttacacagagctagtatgttaaaaaaatcgaaagaaagaaaaccatatagcaatgtgtaccttgaagggtacagagagttctgagaagatctcagggttcagctacttagcttcctttcctctcttctagctatcttttctaccacccacaacagtttccttttcatctgttaacacttctgtcaacatttttcattttattcaccaaaatcttcaaattactcaatttttttaagaacaatttccgcttgccgtgtaataggtgtagaggtgtttagtgaagctaaattaaaagtttactgttagtcactgctcattagttatcagcacctttttctttttgggagttcagtgttgtaaaaagaaggggtgatggatagaactgtagggattataaacttcgtggagttctgcaattcaatgcaataaacctgtatggagtgttgcctgaatattatacatcccacccccttcaatctggagtacctagcaaaactccttccttctagtggggatgttgatgagattaattaatgtaagttatagtaaagtgggctttttgttccttttcctttataaaatacagaaacaccaaataaaagaaaaaaatcacctatgatattttttagagaattgagctttattctctaactggattgttgagtacaaatgatgcatggattatgaccaaatgcaactttctttttgatttttattgatccttgataatgtatccaatggggtgagtttctctggctcccagtgaaaactctaggaggttccatggctttttacattttgatcaaactaacagctttaaaattacttcaaaaaacaaacatagtcttgattaagaaattatcttgtcccttataataatcaaagaacagaaaatattctgtgttaaatattcttcctctttcatctcagtctggcttcaaactgaaaaacctggagcattacttgtagttttctttatcatttcaacctgtttgtctctgcttttccttaatagttaactcactgccaaagttgatggtccagggtggtgtatagagaggagcagacgtggaaaagccagttcttacttgcttgaatattattatgttcattgggctgctagttaaatttggcaaccctatgtggtgttcagttaattgaagctaaccatttcattgtgtaacttttcgggattttcacgaattccctagtgggctctctttcctacagttcagttgatactagtagatgcaccatgtgcagaatggagctcctttctcgcactggacacctggcaccacaccttcagattcattctgctggggtctcttcaatgcttctgggtcgccctattgggcaggactcagagccctcgttatgcattactcccccattgccacccatggtgtgtgggaaattcttacttatttcttttcctgacaaactcgaggagtacaggcacctccatgatcactctccttgttctgcttccaaagcagaaaatcagcttttcccttgacctctaaattcttttcaggtgggagggtaacccctgactgcagtaaactttgactgggtccagtataagttttatgtgtctaattgcagaaaatccacttcaaagttctgcaaatggttcttttgaagccctcttcactaagatttgtatcagaaggtagcaccacaggcatctggggtgaggaggctgagacttacagagacttacagcctggcttgactcttttaggagaaatgtctccatcatttttgtttctttctctttaaaaaaaaaatctctcagaccacttgtctttgagtttaatgagagatccaagagatgcaaacaagtttcatttcacctctttgtgaattcctttctatcctttttatatcattggttttgataaggagaccaaaagagctggggggacatttacattcaaccctttaataaattcctcatatgggactggaaatctaccccattatctgttcaaagtgaggaaaagaagagtttcattttaggttttgtttttttttcttttacactgtcaacataacagttattaaatgtattgtaaatactgatttacaaatgagtcttttccaccaaagataaccatgtgctagaaggcatggactctccttattcatgttaatatcacagtaactagtgcagtgcctggggcatatggatattcaacaaatagtagtgaaaataaactttatgcttatattgcacagctttcactttcattgatatgtctgatcattgattttcttctcagttcagttaacactgagcaaagctttatagaagagattcctaaattagtcttgaagcagattgtaggtggtgatggtggttgtatatgtatgtggaagaaagtttaagggaagcatggccaagagaacagcaagtactaaaacatgggggtgggaggaaaagcatgttgggaaacgttgaatattgctggagtgtatggtagaatgaaaaaggcaagaaatgagattagaaaacagcatacgggttttatataccacaacaaagggtttgcagtttatcttttggataatgggattttgaagaattttcagtggaaaatacattaattgagaatagaatatgtttttgcaaatttataagagacagactgagagtaaaaaattcaattgaaagtgcagtgtgttttaaaatattcagcaataaagcctcgtgtttctgttgattagctatgtaggactttaaatggatcttcaccattatcaagcagtttttactttctaaactttatttttagggaaaaaaaagaaattattgtttaaactatcaaagttattgctattttcacctcacaatcatgaagaaagggacctgggaattttgttcttcactccttgcaagtagattctttcaacaagtgttcatttaattctgagttaaagaaagtaaaactccatacaagaatatcagcatgaaagtatacaggagaaatccatttttattttaaacaagttggtacaaaccaagggaagaaagtagaaactgggttagatgaaaggcagtgcttcaagggaactggcattttgccataacctctctcatttatttgagggtatgtcctgtcatgtgggtaaagtataaagaagcatttctgtgacagcaaattagtcagtataagaaactcaagtctatgttctggcttaaagagggaagatcattcaaacctctttaaactgtgatgaagtttaaaagcaaagaaaatagcaccgacagcaactcttttaggagagagcaacattgtttaaagggtactaaaggaccccaggaaaatacagaaggagccactggaatttcctcagtaacagtgcttttgttatttttggcaaaaattaacttcaaataacctgaataaatgcacaatagtatataaacccccaggctaacgggaactaaccttcagggcagaaaataatcaaaagaagaataaaatgttgtagaattaaaatgcgggctgcagaataggacaaagatttcgaaggaaggaaaaaaatgtgatatttctggagaattagctattaagtcatgcacatttattgtagccagacttggcagtacaactgctggtaaaagaatgtcagaggtttcaatataaaactcctattagaagcagttattgtgtaaaattagctatccagatctttgaacatcccacaccatctggcagaaacgtacaagcccagatgtcctatgtctttatgtagagtttagagtcactgggtatcaaaccaagaaccataaatatctcattccagggaaaagctaagatattgttcataggttcaatttactctactttgtcattagttcaaataacacaacacatttatttatagtacccattctactataaccaaatgaagaggttatatattttctgaatatattctgaagaggcatatattttatgtactgaagagtcatatattttcaatttgcacctccagatccattcttcacccttcacctcctgcaatgtgtttgcagggaaaggggctgatcattgccttttggttatatttggtaaatgggagatactggtagaacatcaaagacaggaggaaaatgaagtccatatatttattcccttcattctcggcctttgcccaaagtcctagtttatttcgcatgagcctttccaaggtgtgtatgcctctccagtttagatagctaactcctcttctttcattaggcttgggatagcagttgttctcttctgctattagccccatggtactgtaacatttcttgttgattttctttaaccttctcatatgttttttatttttcttttttatttttatttattactttattcatttttgagccagggtcttgccctgctgaagtgaagtggtgcaatcatagctcactgcagctttggtctcccaggctcaaggtatccttgtgtctcagcctcctgagtagctggcaccacacctggctaatttgtgtgtgtgtgtgtgtgtgtgtgtgtgtgtgtgcgctacagataaggtcttactgtgttgctcaggctggtctcaaattcctgcactcaagagagccacttgccttggcctcccaaagggctgggattacaggcgtgagccactgtgtcgggtccttctcatactttggtaaatgaatcctttattaaagttctttgttcgaatttgccatttgttcccttccagcgcactgattgataagtatccacttactaaaatgtaaatggcttagcttgtgggaaaatgttttcatgttatgtgctgatctagtgttaggaaaatgtacgagatgacagaaaaccaatcagttagagctagggaagagaaagtaagccctaacattctatttgacacttaccaaagcatctggaggtctttactgagatcctggcttggcgttctcctttttctagttaatacactgatatggtctttctgaattttgaagggtctatgtgtatttaaaatacttttccttttttattgttagcagtttgggtttgatatatttcttatatctgagagttggataaaattcagatataaaaaaataagtacaatgtaagcttcctgaagggaaatattctgaatatctactatagaaattagggcaaatgtggttgtttcattagcattttatttctctacttctctgattgtttcttttgtcatgtttgctcattaacctccaccagttgctatttatattaaacttcctccaggctgtatattgaccttcacctttttatcttttatactacctatctcttttaggatctaatacacaccaggatttcaatatactatatctatatttaaatcactcagtaatttgggcttcttgtttatatttctgagttgtagtccaactgcgtactcatgtctacccttaaatgtcttccctattcaaaactctgacaatttctcatttcattttggccaaaaaacaaaaaaaacaaataccatgacccctgtggctataagtgatttgccttcaactttactgtgttggaatgcagtctaagctgctgtagcaaaaaaagaaaaaaagtaacataaaaaacaatggcttaagaaaggcagaagttgatttttcccttatgtaacagtcaaaagatcaattattcagggctggtcacaaagggttctgctaaccacttacataacactttcattttgggatccaaggtgactgctcgaggtcctgcctttttacttccatcctagtcagtgaaaaaaaaaaaaaaaaaaaaaaaaggaataactggaagacgaaaggaatgaacaccaatcattttaaggacatggtctgaaagtgggaaaacttatcagcggaaaaagaaattggtttgggaattgtgttatacagtcataccatggaggtgcagaccacctcccgaccctggactgtgtttctttaccctgacgtatcctgagaaacaggaatggtacaaactaactttttttcctttagaggagttgggggaggtggtatgtgcaggcattcttcagagtattcttccgcccccagcacccactctcattattttcccttttaccaccgactcttgtcctgaaaggttggttgcctgttatttttggatcaaacatacgaagaaaacccttaacttctccttttggaagtttcaagtttcaggaagccacctagccagttggtttattttcttgacctaacagtagttccatgatgcattggttttaacaaggcagctgaggcaacaaaacgagtggcttaccattctgcctagtcaccctaagcctgagtactagaatgaacagcacataactttgtgtgagtccacatattttaaaaatctcctaatcctatgagttcatagcttctctacctacatgatgcatttggcactagtttgaatggtcccatcacatcctttttacaattgctctcctcatccagaagaaaacttcacaccataaagaattatgttgcaagagatttccaagtcagagaagatagctttcacagaaatcattttccaaagtgagcttaggttttccaattaacccacagaatcatgtttagtccatagtgtagatgatgtgtagcactattttcaattctggatcttaggaatggggtatcatctagtaaaggaaacttaaatgaaaaagaacttcctctctttttgttctgaaaaaaaaaaaaaaaaaaggcattagtaccccttcctcatgtatcccacaagtattccattatacccttgccttttcaaggccacttatatggaaaaggcaaaagaaaaccaacttctattccactactgtgttttctcattaccttcaaattagctactcacactatataaaattgtccctgtctctcaatgacttcagtctgagaggaagaatgttatacgatttaacaaattccactaatatgtgaacaaaaagcaacagctccttaacattctcagaaatcactggagtttttaaagaatgatgattttattgtgaattttttgattcatagaattttaggaaagataacaaggaagtcaagtgaaatcaggaagtgcagagattaaaaatgggaacattcctgcttgagatagctccatagagcctttcctgcctttttcttccttctcctatctctacttcaatgtttacagattctgtgagattttcagttgctttcctggtgatgacattagtgacccagagtgaacagcctttgcatggcagggctatttgtcttattattttacttagctggattacaaactaactaaaccatgtcttacatgtatttttacttttatttttgagacaaggtctccctctgtcacccaggctggaatgcaatggcacaatcagagctcactgcagccttgacgccctccaggctcaagcgatcctcctgccttagcccctgagtagctggggctacaggcatgcaacaccacgcctggctatttttttttttttttggtatttttgtatttttagtagaggcaaggttttgccatgttgctcaggctggtcttgaactcgtggactcaagtgatctgcccacctcagcctcccaagagtgctggaattacaggtgtaagccaccatgcctggacacttgtctttttattatcgtaaagagccaaagcattaggtactcaataaagatttaaagaatgatggtgtcaaagtacatagactttttcctctatttaaataatcaattttcttcctgtgttattcagactttaataatatgtaaccaactccaacacattaggtgagattttctatttctatgtccagcaattcttaacattgtccatgagcacaaatcttttctagatttgccttcttactgattttttttccctctttgggctttttttcccccgtccataccatcactaagatgtgtccgtgtctatgtcaggagaaggatgtcaatcagaatggtggtgaggataagtgagtcggcactatgagaaggtactggaactagggtaaaggaagaggtatttctaagtggagacttgattaaaaaggggagcatcttataccaaccagcaagtcagtgggggaggtctggagtgattaactgacacaggagtttcccctaggtcccctcatgcccttcaggctacaggttgccattttgtaatgacagattttttttttttttgagatggaatcttgctgtgttgcccaggctggagtgcagtggcttgatctcagctcactgcaacctccaccttctgggctcaagcaattctcttgcctcagcctccctagtaactgggactacaggtgtgcactaccacaccccgctaattttttgtatttttagtagagttggggtttcaccatgttggccaggctagtcttgaactcctgacctcaggtgatccacccgccttggcctcccaaagtgctgggattacaggcatgagccactgtgccagcctttttcttttcactttaagattattcttggcatttatttacttcagatatagctataaaaatatttcaagtagagaatggggaaaagtgaggagaagatgaagacaaagtaatttgtctaaacactactctctcctaatgaattaattcttttctttctccctttcatctacccctcctttctctaatcttttcccccttctttcctgcttttctttcgtactccttttacaaatatttactggtacctacttcctgtcaggcattctgccaggctctggggatacagataatgaagacagggctctgattcttgtcttttagatcctcaccttctactggggagacaaacacaaacatagttaggaaaatcataatataattagcttttgtaatgatttccccaaatacaaaaggagaaaaggaccaccctcccctgacccgatttcctgctggagtacacttcatacatgaggaacaatttgagttgaagcatgggtgggagtttgcaaggcagaataacatggagaggaggatattctcatcctgagggatagcgcgtacataatagattgcggcatgacaaaaatcatgttttgaatgttaaagcaccttactgctgtgtataaaatgcacgtagctgagtgatggcagatgagcaatgtacagccagcttttgaaagcctctatatgccatataaaggagtttaggttttgttctgagataatgaaactgttttgatgacttttgagtgggattctgaaataattacatttttaaccattgttggaaagattacgctcacagcagtgctgatggccaggtattattaaaaatacagtataagagagaagtgggcatcaattgttctggtctggtgagagatgaggatctaagccagagcagtaatgaaagaattggagtagaagggctgatttaaatttgattattggtgcagacacggggattggtgattgcttgaatgtggaaggtggaagatacttggaatagtttttgcattggaatttggggtggccctacgcttttcttttcagctggtttctgccaaatgtgaaattgcaatttacatagaaaattttatgaagacttcagaatgaagaagtctgcattttcaagtcttctggtaaactcatgttcttgttgcacatctgagaacagccccacctgttgacagatctttgatggcaaggctacatttttgatggtttccaaagatggaaaaattgcagaataaagttcagaaaacatggtgagcttaaatgaataagttatatttaattgggtatatggtattgttttcaatattaaagatattttgaggcccaattagacaagactttactgacctgaagatgtctaaaattatattatagttcaagaacaagagatgatagaaatttggtcagatcatttcttaatttctctttgttcacttattattaatcacgttgttaggagtatggggactattcctatgagaactaaaggaatctttttttgtttgtagtttatgtcccagtaggtggataatacaatttagttttgctttaaggattttaggatgcatatgtgtttgtttttatgtattttatatatagtgtatatacacatacttatgtattatatataactataatatataagtataaacttgacttcaagataattttttaaagtaaacttttagttcaaaatttatttctttttaaatcagatcttttcacctttgtacatatatatctgtggcataactaatattttttaaagtttatgttcaatttctttcaagtctttgatgtttgattttactgctttcatcttcctttgtgaaagtaatgataatgtggcacctactgctccttgagcagattgaatgtttctgtcccattagggaatagtcttgtgatatttccagaaggatattaaaaatctcactttatagtagaaattatccctttgtgaatactgaatgtctttatcataatgctgtcagttctgctatttttcatacatttcagtggcaaaaactgaaaattagtgcattgatcataatattaaaaatgcatccctttctactacttgatcaatagtactttccagttgattatcttgtctggctgaaatgtctgttatctttcattggctaattctcgagagtagactttaggatgttggtttggaaaacattttaaaaatgattatatctaactccttcaattttcggataagaacattgagtccagagaactcaatgatgataaatatcttagataacattatagacccagggctagaacttacagtgctttgaagcacaatctagcagtttttcaggtgaagtcttgatataaaagattcacaactataagaaacaagactttatttattctcaacaggtctccattttgctttttaaatgtaattattttctaaaaccatccctatgctcaaaagcttagaccctcctctcacttgtggagtaagctgcacggaatattgaatatagactgcatgtaccacagaaagtgggtttatagatctatcagtctcaattccttccacaaccacttattgactagctacagtgtgcctcctctgcggcaatggcaaaaataaaatggattgaatttctggccttgaggcgttcatgagagaattggatacctacataaatgactctaaaaaaataggctgtttaaatgttttagaaaaaataaaaatatagtgctatggggctgtattagggtcttcagaaaaacagaaccaataggtatatatagatatatgagaagtgattgtttatgggaactggctcatataattatagaagcccaaatccccaaggcatgccgtctgcagtggagaaataggaaacccagtgctgtaatttagtctgagactgatggcctgcgaaccaggtggggtgctggtgtaaccatggaggccaaaggcctgagaaccaggagattccatgtccaatgtctgaggcaggagagcatagatgttccaactgaagagagagtaaatgcacccttcctctttttttattcttctggggcctcaagggattggacgaggctcactcgcgttgtccagggtaggttttgtctactgagtttactgatttaaatattaaacttttctggaaaaatattcacaaacatacctagaaataatgttttgccagctatctaagtatctgtctgtccggtcaaagtggtacttaaaattaaccttcatagaggccatggaaagaaaagccaattctgcctgggggaagaagaaatagttgagtgaaaccatgaaaaatcagtaggctttgagagttaaagagtagaacaattggtcttccaggcaaaataaatattgtaaagcaaaggaatgaagactccaaaggcacagatgtgggaatggtagttttaataggcctatagtagaaagtatcaagaaggacaagaaagagagatgaggtcacagactgaaggattttatgtggaatttttcatttttttctaaagccaatttctgattattggcagttttgataaaaagagcagaggaaaaataaacttgctttctttcactgttttcccaaggattttgaaataatatagcttagaccatccacccttaaaaaagattattacagtctgaggactttggttcatttgccttttttttttaatttgattagcttcaagaccccatttacaatgcatatatacaaggttgttattgactctccagtagttagcttttctcatttccctaactcgtagataacactaacaaaaaatttagtggctggatcacggtggatgctaaaaaaaaaaaatgacaaatttaacaactattttcacccactattgggtctatgtttaatgctttgttttttgccaatgactagcactttacacattcgtgtctgtggaagaaattagcgcatgagagggtaaatggattttctagggttttgagtatttccacacaaagtatattgtttgacatcaacctgctgattgctaattatttttagtaggctaactaggctgtaaatatctttatatcattcctcagatcaataatttcatagttactaaaggagtgccttaaagatcctgataccttaattggaccagttttaccctcactttttagttttagacattgtaacggtggctcttctttcataattttatgtcactgtgaagatgctataaacttcctcttatccaggttataaggacccatagtgtcctctcaatgtattgttgtgcttctgctgggtttcttgaaaaaagcactgctttaacctagttctgacagggtctactaatgctacataaccctacaaccaactgatgcctgtgctctgaaccgggcttgtggcagacagcttgcaaatactagatagttttgacatttgcttatctacttttttgtttggtcctgggttcacaactacagtataagccccatgtagtagggattgttcctgatacatttctgagccatgttctctagaaaaaggtgcaggttaaattgggaatgtgaaacattttttttgttgttgttcttcagggttctttattccatctttcataaaagagatgtcagaaaaactgtttctcagtcacctttaccatggcatttgtcttctgagttgattacgactttaattcaacaatgagaagccaatataaactcatcagttcatggtctgtggaggcatgtgctttacagatgaaagtaaatcatataattatccctgctccacaggaagcaaattatttcaattatctgaaattaactctatatctagatttctcccaggtaaacaattgctgtttgggtacagtggtgcggatattgtcagaaaacatttatattaacacttaaagtgacacagtaacacacctacatagtctcatggatagaaagtaaatatctggctaaatcacacacatgcatttagttttagaaatgaaattaagtttattatctgtatgctgatgcttttacttctatggaaacgtaacaacatcctgtggacattagataatgaatagtaaaacattaaaacaaaggttttcagtttttaaaatatatcctttttttgcggcgggtagagaaatcttcaaaacataagaaatagttggctgtattcttttaaaggaacagggttttttggcagctgacttacagccagtcttttctgccaaaatatcaatgttttcttgaggataaaaatagtcttattgcagccagcaaaatgtcatttgaaactacaagtgaccactgtcacagaaaggtattattattaatgcttgcaacacaacaaggagtacaatgatttcggcagagattgctatttccacacagctcagagttatcaaaagagatagcagaagtaaggggaaggtagcagaatgttagcccattgcacagaggctactatcttgaggaaagaatattcaggagacacagggagcaacgcagcgtaatacccacacacagagagttgaaaagatcagggaaacaaagaatatgcaaaaatcaaagaaagagcacgaaagaaaagcaaagtaagaaagaaacgatggaagaaaaaaacagccaacttttaaggattttctgcaagttaacaaaagcctagctatacttaagtggacattattaaattctaataggagattttaagctctttgaataattaataaggacagaatacaaaagaacctaagattaagacatgaaagtctccaaaacactccaaaacgatacagtcaatttgcaattggtgatgtgtgggtatttttgttattattttagagtaaatttaccaaatatatgattaaataattttttttgagactgagcttcgctctgtctgattaaataattttaaattactccattttgtgtttaaatcccatgtaaggaactctgacctggtattatcagtagctgaactgcattgtatccaggtagactgtagtgaccatctggtccctggacagctgcccgagactggacagactattgctgatttttagctgcatccatgcctttttcatcaaatggagaggacttacataattggtaccctaaaaagagacaattacacacggatacaaatactaatacaataatagaattagctatcaggctataattggtattagtgtttttggttgtttctgtcttgctgtgttttagataccgacagaaactattatgtcatgtacttcccacaataatcttataagtccggcttcatcttttccctaaatttgtatataagtaaactgaggcttgtagaagtttataatttctcaagattctactgctaataagtagatgctcaaaaaagttcatctccatatcatgagtttttaaccacttatggtatattctgtaaattagaaaagtaatttgaagtctttaccatatgctggactccaagaaagataacttttcttttcttcccttctaagaatctaaattactctaagaatctcaaaattcttaacacatacattaatagatgtacttggtttgatagtaaggtatattttactagaagtgatacaaagtgggaaggtgagttatgggagtgtatatccccctagctcatggacaacttcaatatttaaaaccttttctgaataatttgccctaaacaatgctttcaataaaaattaggtgatagtaaactagaaattttaccctctggaaatctcagtagtagttatacaaactatgagtcttaccaatttttcaaaggtagaattaacatcttttattaaaatggaagagtataaaagcatttgtaattaaataaaatgaatttggagattacaatcaacactttctcattcaaaacattttccccatagcagttggagaaacttttcacatgattattaaaatggtcattttaaattaatttttgagtttttggagatattctaccttgtttaagagttagaacaaaaagtcaaatttagatctgtttgtatttctcttttccttcagtactaactgtgattatgaataaataccaaatggctcatgagtacaaaaagagcgtagagaattggaacaaactagaatcacagcatctgggagacctgaactgaacatgtgctcggcaaagatttgttggattaaaatacatttcagaactgggagggacactaaggatcactagttagttcaattctatcctactttatgcaaaagaatttttaataccagaagtgatgttgaaaagaacagagatgatctgtaagtgagtaaagacagaatatttaaaatggcgtcctttcacctctctttagtcaactctcatggcaaatcaatggttgctatttttttttaataattgtggccaagatttattccatcaaatatagccttttatgtttagaagggtctttgtggtttcttttttctctttttgtcccatgaacataaacactttaacaccattgcttcataaattaacctgaaaacattaaactttatgaagagggattaggaacaggtagagagtttatgaaaaataatatgtttatactttgtttctttctcataacatatactggaatcatgtaaagttgagtaagatgaactgaataagtagcatcaggttatagattagtacattagttacaaggtagaacatatagcatgagcaatattttttgaagactaatctactgaaaaataagttagtttatctagcatttactaaatgccaggcagtggattctgttcaaaatgttatgtgatttcatgtttatgtagtcccttgagggaggtattattttcccaattgtattatggagaaatgtgtgatttggagagaagtaacatgcttcaagtgagacaagttgtttattgcaatttcaaacaagaagttatttattatgattttgcatcatttgaaccatataataattcccacaaagattaaagataagatacggaaaagaaaaggtatgagcgttcttagagtaaatgaaattttcagtaggactttaaattatatgaaaaaataattttaaattgttatgtttatttaattgataggataatttgaaagtcttctcattcagtttttcaattagttttaagaatctgtttaagacaacagctcaaataaaatttgtagaattatcttaggttattatgtaatttagaaataataaagtgcatttaaaaaattatgtaatttatgccattcacttactttttctagaattaatgtaattagttttgatcattgaggtttcactctttagtagtaaccagatcaaactcttgctcttttacaccaaacatatatatgctcacacagacaggcgctttaattttttcattttcagatttgtagctcaacaacattgcagtactttatgcgctcctttcattctattatatcatcccatagcaagggaaatgggaagaatgtcacataggtctttttttttcttgctttagtcacataatactaaagttaacatttttcttcctctatgtttgttggataattagacattgtataatagattaagagccatatgtgatccctgtctccttaggcatatgctagagcagaaataaattgctaaatataacaaataacaagtttatttccattaacgtagtatattgaaattaaattttatttttggtcttagaatttttggaaggaacaaaagtgaaccctattcttctgtatgtcttgtgggggggcatgcagaaataatacattctcttagacatgggttaatttttacattgctttaaagatgttccaagggaattttcagtgtggagttttgactaaatattgttaaaacttacagtcccacctgctgtctactctgcccttctttcatagttatatcatatccacctctaacactcaatggatgagttttcccttgagtaaaatatgaccaccgatatggtttggctctgtgtccccacctaaatctcacctcgaattgtaattcctataatccccacgtttcaagggtgggacaaggtggaggtaattggatcatgggggcggtttctcccatgctgttctcgtgatagtggatgagttctcatgagatctgatggttttataagcatctggtatttcccctgctttcactaacttcatcctgctgccttgtgaaaaaggtgcctgcttcttctttgccttccaccatgactgtaagtttcctgaggcttacccagcaatgtggaatgatttcagagaatgtatggaaatgcctggatgtccaggcagaagtttgctgcaggagtggaaccctcatggaaaacctctgctagggcggtacagaagggaaatgtggggttgcagcccgacacagagtctctactggggcactaccttgtggagctgtgagaagagggccaccatcctccagcccccagaatggtagatcccccaacggcttgtactgtgcacctggaaaagctgcaggcactcaatgccagcccatgaaagcagctgggagtgaggctgtaccctgcaaagccacaggggtggagcttcccaaggccatgggagcccatcttttgcatcagcatgacctggatgtgagacagggagtcaaaggagattattttggaagcttaaggtttaatgactgccctttggatttcagagttgggtagggcctgtaggcccattgtttgggccaatttttcccatttggaatgggagaatttatccaatgcctgtactctcattgtatctagtaactaacttgcttttgatttttattctcataggcagaagggacttgccttgtatcagatgagacgttggactgtggacttttgagttaatgcctgaatgagttaagactttgggggactgtcgggaaggcatgattggttttgaaatatgaaaagacatgagatttgggaggggccggggtggaatgatatggtttggctctgtctgcactaaaatctcacctcaaattgtaatccccataatctccatgtgtcaagggtgggacaaagtggaggtgactggatcatgggggtggtgtcctccatggtgttttcatgatagtgagtgagttctcatgagatttgatggttttataagcatctggcatttctcctgcttgcagtcattctgtcctgccaccctgtgaaaaaggtgcccacctctcctttgccttctgccatgattgtaagttttctgaggcctccccagcaatgcggaactgtgagtcaattcaacctatttcctttataaattattcagtcttgggtctttcttcatcacagtgtgagaatggactaacacaaccacctagggtaaatatggcccagagtgagagggaagggagtgatacatcctcccactttctattataatttgtgtcgaatgccctccaactagtttatggctttgtgcattttccacatcagaagagaactgggctaactaaaccttttcatagggtcagtgaaaaaaaataactagttcctggggaaaactcaggcttgtctttcaatgtatatgaaagattcattatcgatttagtccagactgcaacaagtgaggaactcacaatcaatcattagtgacatttcctcatgtctgctcatttctctgaaaatgtttttcaccttttaacttttactgaaatctgattcttctctgaacactcagctgccccgaaagaattctcaagccctttgccacacttctctgtcactgtgagcctggcagtgtgaaaagctgtcctccttgctgctaattgcagttttcaggacattattcttttcttctccctacacataagtcatcctccctctcagctgctgaccatgcttcctatttcaccgagaaaatgaaagcaactacaaggaagcttccatgcactcacacactctcttagctgaacttccaacagcatttgtatcatatactttgtcttcccacctgttctaaaggaagtctctgcattcccattttaaaacaaatctctcatgtatcattccaatcagcatcatagtagagtgttatttcttccattttagacattaacaaaaacaaacatgtctgatgccatattctcctctaggtatactttatttctcatttcttttacagcaaaactcctcagaattctccagtttcatgggcttaaataccgtctgcacactagtgattctcaaaatgatatatgcagttcagacatctcccctgaacttcaaataacagctgcctactctacaattccacttggatgtctcataaacatttcaaacttacttacatgttcaaaatcaaactcctgatcttctctctcatctaccaaaatttcccatcttaagaaacatattcccttccagttgggaaaattttgggaattatttccctgttagctaatgtcaacataccaacccattacacatgatttgaacttttgcctcaattttagcattaggatggagttttattttatttatagaatgagtaaaataatgaaagaaagaatatgaagaaggaataaaggaaggaagcaggaaagggaagaaggaaggaaagaaatggaaaaataagaaagatatgaataaaagaattacttttagcccaagatgaataaacattgaaaaaacactggtcattagaatctgaaatcaaaatgactaaaatgttttaggttatgctaaattgaaggccagtttaatcaagccagagtcatctatagtagaagattctttatttgggggaaacctccccaacaacagacttattataaaagaatttatacaaatttaaataattgattaatatgcatgtgtggcgatggtgatgcaatctacagtgcaaagaatctccacttatgattatcatagggtccaatcagcataatttcaacaagcagagacaatcacaatgaaatcatggagaccttgaggtaagatatgaattgggattcttcttagtaatttttgtttagatgattaaaataaatagatcatccatagctagctaggtaggtaaacacagacagagataggaatataaagatagagaatatagagacacttagatttttttaaaatgtattactactgtgatggttaattttatgtgttaacttgaccaggctatggagttcccagatatttgaacaacgaatattttgcatgcatacgtgaagttgcttccaaaggagattaaaatttgaattggtaggctgagtaaagtaacttccctaatgtgtgtgggcctcttccaatctggtgcaggcctgcatagaacaataagcctgagcagaagagaactgcaccttcctgactgcttttgagcttggctatcccttttttcctgcattcatacttgagctggaacattggctcttcctggttcttcatcctccagaatacctgaccagaactataccctctccttggtgtccagcttgctaaatgaagatctgggacttatccgcctacaaaatcatgtgagccaatttcttataatgagtctcactctctgtctctgtctttctttgtttttacacacacacacacacacaatttatatattggttgtttctcaggagaacctcgaatagtacaactaaattgtatgttttttaaattcgatctttcaccttgtttggagttaagataactaaattccagaaatatttttaatctggtacaggttaagtcctgaaatatttggataattatatttttatcattttaataccaccagtggctctctttcttttacatcttcatcagcctctttgcatctcacataattaaggataagaaaaactcaagtcatgtaaaaaagctcttcagtagctcttcagtgcttcacaggcttgtacatctctttgacttcatacatgctgttgccatttactggaatatcttttcattcttcattgtctagttaacctttctttaaggattcctgtccccagggaactctctcttatcctccattctgctataggtcccccactctcaaccctgccacattctctccttgtgtcttatacaggtttctgccatgggacatgtcatccagtactataattattaataaatatctttgggtcctccagtaaaaaatgttaagcactttagaagggtagaaactgtatctttataaacatgttttatgtccaactcctaaactagtgccagctgtaagtatttattgaaaaagtagttaccacataaatgccaatagtccagcctatcccatgtgataatttagaactctgagaatcttaaatatctgaactaattatattcttctttaataattttctttatacattttcttaaacctaaaagcaattctcaattatttgcaattaaataagcaaactatacaacacatttttttctcaattgcacatgaaagaggaaaccctgtgtcactaagcaatcatcatttatttgtctgttctatatgaaatatgcattggttttctaaacaaaattgctttcattggaagacttgccattgcctttggtagctcacgttttgactgatgacagcgatggagaaggaaaaaattgaatcatagtcatcattgtattgaatcacgggtagcctgcggctcacacctgtaatcccagcaccatgggaggccaaagtgggcagatcacttgaggtcaggagttgaggccagcctgggcaacatggcaaaaccgcagctctacaaaaattagctgagcgtggtgccacacacttgtaatgccagctacttgggaggctgaggcccagaatcgtctgagcctgggaggcagaggttgcagtgagccaagatgacaccactgcactctagcctgggcaacaaaaggacaaacgcaagactctgtctcaaaaaaaaaaaaaaaaaaaaagttcttaaattgcaggtgagattttatgggcagatttttacctaacaacaaaatgatttattttttatattataaatgtcaaccagggaaaacctaaacttatcatgtaattcagttagggctgtgtgtaatcctttgaaagccttcttcaataagcagtgctctgtcgcccagactagagtgcagaggcgccatcttggctcactgcacctccgcatcccagggttctagcaattctcctgcctcagcatcccaagtagctggaactacaggcgtctgccgccatgcccagctaatttttttgtatttttagtagagacggggtttcaccatgttggctaggctggtctcaaactcctgacctcaggtgatccacccacctaggcctcccaaagtgctgggattacaggcttgagccactgtggccggctgcaatttttcatttctatattatctatcttcttttataatatttagaccacactgtaatttatgtctatggtctttctaattttcatattcacaagcatagactttagcattatttggctgattatgtttgtttgtacacattaataaggtaattaccaattattactaatatatataagccaatgtattagtttctattgttgctgtaacaaattaccacaaacctaatggtttagaacaacacaaatttattacagttctggcagacaaaaacctgaagagtcttaggagcttaaaatcaaactgtcagcagggctgcattcctttctaaagggtctctggaagcatccatttcttttggctttccagcttctagaggcagcctgcatatgttggcttgtgcatcctttccccattttaaaagtgcatctccccaatctctgcttttgtcatccttgcttctttttctgattctgggcctccagccttcctcttaaaaggaccattttgattatactgagcctacccagaacatccaggatcatattcttatctcaagatccttactttagtcacatctacaaattccgtttggtcatgtaagttaacatatgcacaggttttgcgaattagaaagcagacatctttggaaggatattattttgtctaccacagtcaatatacaatttttattatattttgccaaaaaaccataacacagcagcagtaaatatcattagaaggtgtaactcaatataaaaagaaactttctcataattatttctgattaaaagtaaacccaatttcttgaatactgttctactccccactatcggaaacatatagacagaagctagataaccatccatcagctctgttatagatttgaaatagaggttctctctattttcttataattttagccatctcttttgctttaactttcataagataaagacagtagaaacaaaaggtaatttactcatttatctttcaattaaatttgcaaaaactaatggaagggaagatacagaataaatcttaaataagccatagtgcttgggatgtgaaataagcttatatatttttgtacttaattttgtgtgtgtgtcactatatgtatacaatgaattgcagtgatttttctccaagactttaattctaattttcagcaaaatgaaagcaatatacatttttacctttaacttaaccaatttgagaggctatgagcagaagtaaaaagaatgaaaaaatgatgaactacattttttttttttttttttgacacagagtctcgctctgtcccccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcacagtgttagccaggatggtctcgatccctgacctcgtgatccgcccgcctcggcctcccaaagtgctgggattacaggagtgagccactgagcccggcctgaactacatttttgagagattgatgtgccccatttcaggatgacctaccaaaagtataagagcatttggtggttcaacatactcatcttgtacatgaggaaatggaaatcacaaaactttactgacttgcccagggccatacaactagataattacagagcagttgtaagttccctgcttttctaactcctaatttggtactctgtccacaatactatcaacttttcaatatcctatttagtatatgattttctctgatttggtatgatttctcttttccttaatctccattttgtatgctaaattaatattatttaggttgagtcgcttgagagggaaataagatcttttccaatatcattatgtacaaatagacaaaatgcagtcaagcttgtttcttctttctctgcaaagttaagacgtaagtagggaaagaaaaaggagcttaatgatgttttcttgccttttcctttcttctatttattctttctaagaagtattaagattagttgaactaagaagatcttgttccaaagttgaataccagcagtaatagaagggtaactaggtctcatattaattaatataatcattctctgtgtaggggttgggggatgtaggaagcaataaagttaactgaaatatttaaatacatattgacaaatgaatcatcatctgtaacaacttaaaccatccctgatacgtaaacaaatagctttcctcactgtttttcttttaactgtatttgaatgtgctcacctccatgctacatataaactcatttgtaattttatcaaagtcttattttatttttgttttagaacaaatatttagatatggagtcttaccttgatttgaccgacaaagaggtcatgaagctttggcatcaatgagggttgcaatgaataaacaatgaattaattccattcacttgattcattaccctcaaatgtcttctgctcagtttggggtcattatattacaatagctatctcttcagcgtaagcttcgcattactctttttacatttccttctgcatagtccttgagtactttaagatcaatcaaatgaaagtcattttattctctgtttctagtacccaacttataaagagtagaatatatctgtagcatctataaataataagtataataagaggtctttagagagtcttgagccaaataatatttcagtttgtttttactacagtgatatgtatgaagatttcattatgacacaaaacttacgtacatgtaaaaataatgactgttggtcctgattccagataaataattcccgatgcagccgtaaatgtagatcactcccagaagagatggcatcttttgtaagtcatattttaccagtgacattttggtgctagttaatcaacatttccagtactgattctctatttgaagaaatcttgccatctggaattggtccctctagtaatattatttaaatcatcaaggggcaattcttcttaatcatcttcaacttagttggaaaaattaataggcttgtctattcaatttatgtcctccctttggggttatatagatgtctgtttatttgtaatatttaagcaactttattactgacattttttccagagcattttaacctacaaagttaatcatacaaaatatttaatttctgatactatttagaagttaaaatccaatgaatctgactccactatacttatatttgtttttaattattaaaaattattcttgatggtggtgctatgttcttggaataatgtagtagaaaaatggaggcaatatggcttttctttatatggcacagtaccattataagtgtatatactaagataataatttaaacagaacctttagatacttaaaaaaaggtcagcttttaaaaagagttggaaaaatataggtaatatatgaatttatcaaataaagctaagacattacatacaataaaagtagtcaaaacaacatgtacacattaatgaaatgtttggacttataagtccatgcaaatgaaatggacactaagaggatatactaactttgccaccaagcatcatgaaacacagataattcacaggagtattgaagttgcagcaacctagagagctactacaagtcaaaaatagcactgaggatagtggggtgtgcaggaaattaacaagaaatttaaggaaagctgatttttggcgtaagtcaagataagtaacctggcataagagttctaagtctttaaaggttcttaaactcagtcttacttcactgcctcagtatcttgtctgatggaaaaatggatcaaaaacatagattatattcatgaatcatttaacccaggatttcaagtttattaggtgttccttgacttatgtattcttcatatattcattttttcatgcaaaaaatacttattaaatatcttatatcaataagacactgtgctagctgctagataggaaagaataggatagtgcccaaagcactgaacctgcccttataatttattagaagggataaaatacaataaatgaatacattacaatttagtaagagagatacaataaaataactactaataaagtaagaaaagcatgtgtacactaaatactatttcaaaaagaaaagagtgattaggaattgttttgcaaatttggggtagggaggaaatccaattcaacttttgttcatgaacaactattctgcatcagacacagtacctgtagctaaagatacaaatataaataaaacatcattattttattctaggggttcttagtttatcaggattatccactcttggggtgcaaggaatgtcagggaagaatttgtggaaaaagttgtacttgagttgcatcctaaaatataggtaaaattttgacatatggagaagagggaaaaaagctttccagggagaggcaaaaccatgaatacaacagcatctgcaatcttctctctaaacttatttttatacttctgaaggcttggtatgaaaataacagaaggcatagctctgtgatacatgctttacaacaccttgtttttaaagcaaaaaagaatcaatgttcttggaaaaatcaattttttattatttcagcaacatttttgaatgttgccattgaaattacctggcactgtagatagagatggtcttatgctatttctgtattttagattcccccaaataatctgcaacctcttatagaaagtaacagagataaattaaacctcattatggtatggtgtgtaagtatttttaaacatttttaaaataatagttgttcgtgagtggggtctattctagatattacatatttccttttgtatttttttttacccttcatattatttgcatgttgagtatagaaaagaaaaaaaattaactcatgagctactgaggtggatttgctactggatgagtaacatcagcagaaatattacaatagctaattgagggtcaaggtcttttgaaaaactctttagaagtctctactgagaagagcaagaagatcaatataagcagagggacagagagcaatccaagggaaacagtagagaaattatattcctaaatgcggtcttttctccatgaccctctgccttgattgagtaacttgagaaaatcccttttctgaccttccctccttaatattatttttgaatcttcaaaagaatgtaaactactttctcattatcatagtttgtgaagacataagaagtccatactttgcacactggccataaaaaacagttttatctgttggtagattctttgtttaaatatatctttcccctatgtgatctcttctccatgattagtttaaaagttcttttcttgatgcagttgggctttgatattatgaagccactcttcgtgttttacattttttcctaagaaacttgtaaaatatgcctttttggatataattatgatgtaaacttgtaaggtgacaagtttaaattggagctttgaccaaaatgatgggctggttttgagaagctatgctgataactttatacaatattcatttttcacaaagctgagaagaggaaacagcaagagtgaaggaacgtgataagccttttttattattaggagtccttaatatatggtccgcaatagactttagatttggttataggttgattgatgtaagtggaatatttgcactaaattttatggtttaaaatatgttttcacatgtattaatatcataaataattgtataagctccattgctgttatattatttcattgttatgaaaactgagcttcagacatgttaactcactacggaaaagttgtactgttagagctgaaagccacttcttatttcatgtccagcttctgtttttacactgatttggaagtacaaaatttaaaagtgtatttaaaatattgtcataatagcattagtttcgttaaaaatatagttcatggtggccgggcgcggtggctcacgcctgtaatcccagcactttgggaggctgaggcggcagatcacgaggtcaggagatcgagaccatcctggctaacacagtgagaccccgtctctactaaaaatacaaaaaattagccaggcatggtagcaggcgcctgtggtcccaagatgctcaggaggctgaggcaggagaatggcgtgaacccaggaggcagagcttgcagtgagccgagattgtgccactgcactccagcctgggcgacagagcgagactctgtcaaaaagtaaaaaaaaaaaaaaaaaaaaaaaaaaaatatatatatatatatatatatatacttcgtggtttttgattggtaagtgggcatagactgagtagattaatgaccagtgttaggtgaactaaaatgttcaaggaccaccatttcaacatcatattgtagatttaaaccagggtaatgagtgtttacagagctttgatgttgtcctaatacttgaatgctatcaggaagtaatatcactcagatatatggaaatgtacagataatcccagtgattcactgtaattaatttcacataacctaccaagacaacagtctggttttgtatctttccccagtttcactactgccaattaagttgtgttttgtgcttttaagtaaattgatgtttaattaatacttaagtaaatcagatgcaaagtcttagtttcttagctgaaggtttatccagtctcgcttttttctttatacattttcttagtacaaaaattgaagctttaaaaataattgccagtctaaaatcctcaaggatgtgtctgcctagaagagtcagtaacagaatatgtgctacgttttatatgtagccttcccaaataacctttcacatctctttaatacatccagtaattcttttcatatggaaaacaagtttttactttacatttccctagatgactttcagttaaataaaatacttatggctgaagtaggaaacgtgttggttttcagacatactagattaatgaatgatctcttcaggggagcaatgtttgataggtgaatggattgaagcctgagtatatggattgtgtatatgaatacagggagggaagcagagtggtgaggtggaaagtagaaaattgaaagctttaaaggcaaaaccgagaagatgaaaactgcatgatactatccaaggaagcttgtcctcaggtctcacaaagtttatgatattactaactagaccctacaaaagaattggttaatttttgataaatggtcaaatattattaaaaattcattctagagtttaacaaagttttcagaacatctaggctcctcattctataggtatgggcatgaaaatcacagcttccccaaagtcacatctatgtatatcatcaatagaagaggtagggtctagaaatgaaggaccttgaatcctctgtttctcccacttgtgctgctttccctcccaacagagcatcaatcatcacaattgccactttgtaaagagaatagttgcaaagctataagcagtaagaattttaaaagaaaaatgaagaaaggtgataccatttaactgtttctagttgccaagagaaagagtgagaaagaatatttacttcttccacaataaaagtttaattaggttaaggaagatgagaaaagatgagaccaggaagctatttgctccatcaaaacatagacaggctgccttgaactcttcagtttttgccacatcagggtttactggtgcataattacaggtccttgccaaatgtcatcaatccatattttctgttctaatttgagttgatcctgttatgaagaggatgtctctagcgcacgagagaaacaggaaaagacagatttttaaggcgaattttaaagcaagtagtaatctcagtttatttctcttgcttttttttttttggctttttctcagtttcatttaaaaatagtaagaacaagaactttaattagatttatgtatgaaagctacacttaggcagtttaagtctgattattttctttagcaatatcaaaattgttatggtatattacattatgaaacattcaacaatataattattaaaatattcctactgcttatcatgcctatagggctttaaagcaattatgttatttagggcaagagatctaattgcctgggttgccttggacagaaaccacagtttggtgatggagattattgctgaatcattgttatattttatgtctgtagtgtgagaaagtatcatgaagataagtttaacatatttctacataagaagacagtaaatgtttcctcaaactcagcacggttcccctgatagggcattttctgatatatttatgagacaagtatgactcatctaaagtttagcagtcacaatggtgtgcagatatggccatgtcacctctttttaactgttccccaaatatgtagctggctccagtgtcaatgttgtgtttgaaacctgctcagtcatatttatatcctcctatctttatagttcagagcagagaaattcatggttctgattcacagggattactgttttgttacaatgttcaaataatggtccgctaaaaatcttcctgcaacagaaagaagtccactcttctaccatcaaggtcattactgaaatcaatgccttcagtttaaaagcacagagatgccatctagcagccgccctcagaaattccctacacagaaatagttctttccctataaaattgagcaataattgaattcctacaggctttcggtgtttgaaattttgcttacagaatgatgatttggcatgtcgtctataattcaaacactccattacaaatgaaattaattgacatctcttaaaataggcagtgatatacatctgagtttttctaaaaagaactggaaacttactaattatactttaattaatagaaagtatttcaaacaaatttcctaaaagaaaaattgatcatctgtccctataaaaatacaaataattaattagtgtggattgccttcctttgttggaaaagaataccaatcttgccaattttttgatacagtaaatgagagaaaagaaactaagtacatgctgaaactaagctcagtctatgaacaatgaatcttggccatttttaaaaacctgaaaacaatactgactttcaagtaacttatcttaccataagatggcgatacttaagcactttataaaatgccatataagacctgtaagcttcagcgacagaaaaaaaaaaaaaagacacacaccgcattataaatgtaaacattatatagtcttccatgaaatagaattggcactgttgttagaaaacccagttgtcttcaggtaaactaatatataagaagtactttctaagatgtagatttccagtatttgatatatgtaaaatcctatacctaaaaaaaatctattcaattttaagagctttcccattttgccagtttctgtttatccatgtgaggtatatatattatatacatatataaaataaacaaagtataacaatatagaataatacttaaaattatttgaaaatttgatgatgacccatatcactccaaatgtattagtatgcaaaaaggcagttggttagcatttctgttcatttaagtgttatcacaaattatttcttatttgtccaaaaactgtattttttgtagtactatattattggatttttaattttaatttcaccatatataatttgctttatgaatcctgacttttaaaatctaagcccttaagtaactagtagaatgaaaaataaaattttacaaaattcttagtttataacctaattgacaattcttttgaggacacaatggtgccatctgtaattttttgggggggagcaatataaatatatattatataaatataaatatataatattaatacaaaagtagcttctcttcattttttaaagcaatgttttgtctaaaagtcctaaaactttttacaacattaaaattacttgttttgaaagttttaatattctctgtaatgtctatgatatagaacaaatatcgtcttttaaaaaaatcatcttttgttctttgcacactgtattgcagtatgtggaagctgagaaggacagtttgaaaagttaatgtatgccttccctggatttttcagctcatttgtagcaaatatccacagctcattctgaagaaagtaaaaagttttgtagcattgaatacacacaaataaactcaccaaaactagaaaagattatattgaccaaagatgcattgcttattttaaaaatgtcttcatatttaacagaaaattatctacatatttaattttggaaagaaaggggtgcaagcagtgaagatatttatgcatcaaagataacagacaaatcaaatcacacacaaaattgttaatgaagctctacatttctgaatttattttaaagaaaaacaaataaaactcactttaagtcaagtgactttttctgcagtaacttagtgattaactttgcttttagaaaatgttttaccaagaatattcccaaatcatatggaatgtattcaaaagttttaaacaatatcatataaaaagagtggcagtggatagaatgtgtcactacagggtgcagagtcaagaagaaaaaaaattaaatataaaaacaaaatcaacactttttcctaagtgtaaaatgctttaaagctacaccttagtatataaaatatgcctttaagattattaagatgacattcacacagagtgaagcgtttacatcaataataccagtacaatcaaagctttaaaataaaatgaatttattctcatcaggtccttctaaatatgaaagagtacagaaataattacaaatatatacgacatgattctaagttttaactgtatactatattaggcctacaaatatcacaaccacagtattaaattatgcttggttacatcttagttctattcagtaatgaaaggaaacttaatttgtctacactacacacatgatgtaaagctttaaaaataactttataatattccaaaatatagcttgtattagttttatagcatggaatcattcttcctatattgtcaaattgctgttggccagttaaataagtaaaataataaattgtatctcttactctttttcaccaggtggcttatctcttattccctgtcattatgattttcttagaaggctgaagctttcaaattatctcactttgtcatcaagacttttctcagacatcgttgaaaatatttgtccatattttcctgtctttttatcaaaggagtttagcgttcactttcattgccagtactagataattttcagagttcaacgtctatgagttaactcatccttcctattgccctccttagtttgttaaggttctcacttcctgtttcttaacactgataatcagaacttcctcagtgccccctaattttcttaatgaaaaggaagaaacaaacacaagctcctttcaccaacgcctctcagccatggcagagagtatagctctgctgctctgccatgtgttttacaagcagcatcccaaatgttttggacacaaaccgcagcacgtctgcgatgggagtattattgaccaggatcagctggaaaacgcttccctgctttcaacaaagaaacggttcaccatgtcctaatacatgtttataaattgcattgtttctactgcaaactcctttgcattacccgtccgacttcaaaagagagcattaagcagttggacacggaataagctaaattccccggagagccgcattgcccgctgcccatgcacattatattttctcctagtccctccccccgcgcagtaggactctaccttgaggagctattcctccggtagttcaccttgttatgttccaagcagtggggatacgccagacaccataaggtagctgaaagagctgtctctcgtcccgtttttgacatatttatttgcatttctgttaggtttgttacatattgcacatttatttcaaacaagactcaaaatattgttcataccttggaaggatctaatccggcaaacaaagacagcagcaggaggttgagaaggttggacgtcgcctgcattctgatctgggtttttgcccctctttactctcttttatgtaggctctccactcactgcagagacctttccctcgtcagttgcactttctgcctgccagtcagagccgagtggaagcagaggcggcggcagcagcagtagcaataacagcagcagcggcagcggcggcagccgccctggggggcgatcattccgcaggcattctcagagctaggagtccgggagctctagagagtgggttgggctgcagtgggcgctggccgcggtgctgaagcgcctccaacccgcgcgccccagtttaccctctcccccgctgctatatagctagcccacctcaaaagttttgacccaaggaatagataaagggattaactgctgagagaggtgtggagacctggacaacggatatgacatcactac

SEQ ID NO: 1584 - DNA, 20866 bp, Homo sapiens
cataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcaggtgagggcgggggaggtggaatgggtctttggggctgagagcaggctggcctgggagtggaggagcccaagcagtggccatcacccccctccgacccccacccccgccagcctatgtctggtgtgtagggatgacagaggggtgctggtgggcttggacgggagcctgttcttgtggttgcctaggccttagtttccaccagagggagagcaagcagagatgagctgggacaggcaggcctgagacctggctttgggggacacacttgggatagaggaggatcccccatggcccggcctgagggaaggtgctctggagtttccctccctccctctgtgccccttctggtctcctctgcctttttctggggacattgttcagccgggtgggctgctttttagggcccagtactggagcttgaagaggcccaggagggatccctgtgttagggagggggtggggatgttacctgaactgcctttatctaaaagcaatgccttagacacttaagactcatagcctcctgggtgggggtggtgccctcgctctcacctgttgactctggggcaggttccctacagctgtggagggcggcctcggcagaggcagatgtgagggtccgctatgtggctgtacgggtttccttcttggcctgacattgaccaagaggtcgagattcagaccggggacctggaaaggctttagacactgtgcagtctttattgtgcacaggaggaaaggaagccccgggaggcctggtgacttccccaaggtagtacagaccgcagcagaaccaagccttgagcccacagccaggggctctgggcatctgacgctgttctctttgctctacttggggcagcaagtcatcccagagaggacccagcatcaggctgggaccactgggaagatcagtgcctcccctttgatgctggcagtcagagactgggctgagctgggagaaggggaagctggcggagacgggaggcgtgctaaggtacccctctgtccctgtaagtccccactcctctgcaacagtctcagagcccctgagaagcaggggctgagttggcccaactttccaaggcaactacttagtggttaataattaattagcaagcgtgactaattaatggcttcccctcccacattacttcctcctctgtgcaaagcagacacactcagcatgctagctgagaccaccttgcttcctacctctggctgcaccctgctcttggcttctggggagggtgggaggatggctagggtgggtgggaaggggtgggggtgagctgcctgctcctctgtcctgttcttatctctacgagggatagagtttgggacagatggacagtgcagagctaatagtcatcctaagtatcctgcggggtggggttccagaatatatggccaatctttcagaactttggcatgtttgcaaaggcctcccataaagttaaaaaaaataattctcccatgcattctctagacttccttgaataattgaaattccaaagtgcaaggtacatgttgctttcagggctttgtgtttgattgttgctgcctgtggttgctgtgttgtttatgtaggtctataaaagttcttgatcgtcctgctcttatcatcttgatgggtggagaggtatcaccagggacctggctgacagcagtcccctctccctgttggccttgctttgttaccagctttcccaaggccgacttttctgtcgtgttggctgcctgaggaggggtggagctcacctcccccaccctgcggccccgcgctctgaggaggcaggataggctccagacagaaactcggaaggacttttggactcttgctcaatgggctgactcagtgaggaggtggctgagctctctttccagacccaaccacctgcatgggctccgcccacccctcccacccctgctgcagccagcagctgccaggccctggccagctgggaccccaaccaggggtgtgggttggtgaggagggagagggggtgggcacaggtgttatctgggtgactggtccctagctgagccgacacaatgggatggcacctgtaccacccaagtgttctccaccccgaagcaggcagaggagcaggtgatctcctttctgtccttgcacagcttctgctctagtcactgcttgcccctctcctgtcaactcttggcaaccctgatagacacagccctgggtctcccctggctgtggggtgtaggggatctaggctgattccccttcagtggtctcccaggagtaattgatggcttgaaagttgtttgagggctttgggacagctctctggcatacagtggctgcacatatctgcagatgatgtgaagttcagagtccagggcgccaattcagagagtgggcgtcctggacttcggaggccccagaccagggccttggccatgtgcctgcccacttcttgaagtgtcctcagccactggggcgtaggacatgcctcacacctcctgggttcttgggttgaggatagctgtgtcccataaagatgtcttccccttcctcctttcttttttttttggagacggggtctctctgttgtccaggctggagtgcaatggcgtgaacatggctcactgcagccttgacttctccaggctcaggcaatcctcctgcctcagcctcctgagtagctgggactacaggtgcacaccactatgcccagctaagtttcattttggagagatggggtctaagttgtccaggctggtcttgaactcctgggctcaagctatccttctgccttggtctccagaaatgctgggattacaggcgtgagccaccatgctgggcttccttcctcctttctttgttatcccatcccattttttgtccccttcctttttatcctgtctctgctcttttccttcttgcccttctccccagtcgagcggttcttgtggctaccacagctgtcgacccccttaggcctagaggactttggcccagaggggagttaggctgggcccctgagagcccactgagaacagggtttgctggtgaggcccacagccccttctctaggtcagcacccccagtgccagaatctcctgccccagatggttcctgaagcacagtcctcccttccactcccctgctctcaagcatctattcagctttttgtaaccaagatggttcatatctagcttttttgttattgttctcttttctctttaaagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggtgagtgttcagggaaatccccctgccctagtccctagtccctggtccctggtccctggccctgactcctgagtcctgagccctcaggcactagggctggctgggctgagactcccaagggctgagaggaaggggagggagaggcctctgctgggaggagggggaggttctggaagggctggagcctcagggacatgtggagttttcctccctggagaaaactggcttggagttttggttctatctggaagagggatctgcaatgttcaactttagccccagctgagaagttgaaaaatctcaggcaggcacagtggctcatgcctgtaatcccagcactttgggaggccaaggtgggcggatcacaaggtcaggagatcgagaccatcctggctaccacatagtcccagctatgtgggaggctgaggcagaagaatcgtttgaacctgggaggcggaggttgcagtgagccgagatcgcggcattgcactccagcctgggcgacagggcaagactccgtctcaaaaaaaatatatcatctggccaatgtgaaggtcttgcctctctgtttggccagacctgtgggcctagtctggcctagtcttgacagaggacaagaaagaagaggcttatgtgtgtgtgcaagagagaggggtagtggggagagggagagagagagacaggaagaagaaggagaaggaaaagaggaagaagaagggaggaggagtggggggaggactgcaccggcagaactccctcccctgcactcccccaccataggtcacctggtgggacgaccctcccttctgagttgtaacatttgtgcagccaagagacgtggtgttttgtggctgtgacacaggccacagcagccagcctgcaatttgtgggcaggcatgagatgtgtgtgtgtgtgtgcatgtgtgtgcatgtgcattcccctaggggtggtcaataagtaacggaggaggcttccatcttcagcctccctgagcatgtgccccccaacccttgcaggccccgacagcccggtctccccaatgaaggagctgacccatgcagtgcacaagcagcagagggccctggaagcgaggctggaggcctgcctggaggagctgaggagactctgccttcgggaagcggtgaggccccagccagcacacacaagcatcgggttcatctcaggagctgtggagccacgtgtggggatgcgggagctggggagagggagccccattcttgagggaattctggacatcaggctgggggctggggcccagagtccccatgatgcagtgtttgaccttgtgctggatggagaagagtcagacccaggcaggggcccaggcacagagaacaaagttcatcaggggctgcagagggactgcacagacataagtgcatatgagtgctgtaacccgggtcggtgtagctctggaggaagtgatcagaaagaggtctgaagggaaaggggaggagtgcagagtgggtctgaagacaggagagacagtgtggaggatgggatgaggtggggtggagggtggtcccaccagggcttctatggaaggcaggcacatgcagtgcaggggccagtgagccaagtctgggcaggtggagaggacctggctggtctctgcttcctccccaggagctgacgggcaccttgccagcggagtatcccctcaaaccaggggaaaaggcccccaaggttcgccgcaggatcggagcggcttacaaactggatgactgggccttgcacagagaggtgaggaacctcaggaagctgccagtacccctcgatccccaaagctgatcactgagacgccacacctcagctcagtaccctggcaggttcccttccaccctttcacacccagtgagggtgcttggctgcctgttggtgagagacaccatgaatatgtagcccaaatggctgtggagaaggggcgccactaaggaaccgagagctgggagctcaagggaggacactgggtttgaccccattgggcagaagatcagttaagagcaccagccaccaacccagcgggcaatagcctgctcagacaggttactctggcccctagggctgtcctcctttctcaggaggaggtgggggcagtcaggccctgggtgcccttcccctgtggcgtcaatggcagcagtttcccatgggccagcctgccccaccctttggggtcaggagggaaagtgtcccacttgggttcccaccctgcccggttcagcaggtgggctggtgggtgggtgcccatgccagcttttcaggctgacaagtttgcttttcggctcctcccactccttcaccctctgctccacgtccgtccattggtgctgctgtctgcctctcttctgtcctcagggcttaggactgggacctagagcactgtgtcagggctgctgtccaccctctgggcccccaatctccctgcctctctctagcctcactcctgccccctctctcaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgaggtgagccggctgccctgaggggggccatgctccttaaatgagcttttgagggatggtgggcgcacagccccgtgccactgcctttgcatttggctccagctgggtaaagctgattcttgggttcagctccaccccatcctgattctctccaactccagcaaggcttccccatcctgtgaggtcttcttctccgtctccttagaaaacaccctactctctccttccgtatcctcctcaaaatacactaccttcaagagacttcctacacagagatatttctcagctgaccctgagctgaatccaaggtgtattcaactgggtagcccaggctggccccgctgccctccaggcccacagggtgatggcatctctgggtcagggtagtgtgaggctcccgtgagcccaaggctctgagttgatgtgtagtcccctggcctgagttaggcagcaaagggtttgacgattgctatgtgttactgatcactgaattgtttcaggggcccacagctacttaggagatgttcaggttgaaatccagcaggactggtgccacaccccacagccccttaagtatctacaaccaccctggtcaagggtgggatccttccatgtctgttctctgccctccttgtgtctgtagttcaatccctgagctccttggcccagagactagtggccgtgggggcacctagtgagttgttgatgcccaggtgctgccacatcacatcagtgtgtccaccacaggttagcttccaacaggtggttctgagcccttaggtgtgactgttttcctttgtcctgacccaaggccagcctgtcaggtcaggacttgcatctctccattccaaaccccaccgcagcaggcccatgactcagctctgccccccgtctctcacatgggacccagacctccctggctgcctcagagggaaccgggagggaatgaggccgtggccctgcaaaaaaaaatccagaattggattcagaggtctcggccttcattcacattctcaggctcccatccctgcatatcgtgttggctttttgccaagactactcctcagcctgggagcagtcatggggaagctggaaagcccttgctagtccctgtgccctgcagcctatgcctcaggcagggagttatctcagcacaggtctcagaagtccctgctcctatccatggcttttaatttagggtagaaagtgcatgaccagacaccacccaggtcacctcccgcagccaagagtaggtgataaaggaggaggtgcctccatgtgacagttaacccagtaaactcagaagacagtggggctgacccagggaaaatggccagacctctgtccggttccagtggttctggcttggccgcagaacaacactcccagtctctgaggctctaatggaagacaagttctacaaccttactccactctcaacagggatcccaggacttgacagcaaccttgaaaggtagctgctgaattggacatggaagcccctaagggccaacttgctctgtgcctgcagggagaggtcagggtggtgagatatgcccgttggttgcagcgcctcctgctccccggtccagcctcacactgctcagcagcctcccctgcccaccggggctgccattgctgggagcttctgcccatgatgggtggcaggggagtgtcaccctgatgctgccattgtgacccataatgcttcttgttgggagtcgggagcaggccaggactggcctggggctctgtggaaggcaggaggatgaggttctgaaaccttggagccctcagtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaagtaatttctgttttgtggctcctctgcccagccgagccctcctagaaaggaggaagtaaagcagaattattagtagctgaggtgttttgaattaaaaagggaaggccggacactgtggctcatgcctgtaatcccaatacttttggaagccaaggtgggcggatcatgaggttaggagttcaagaccagcctggccaacatagtgaaaccccatctctactaaaaatacaaaaattagccagacatggtggtgcatgtctgtagtcccagctactcgggaggctgagccaggagaatcccttgaacctgggaggtggagcccaggatcaagggagccgagatcgtgccactgcactccagcctggcaacagagtgagactttgtctcaaaaacaaaaaacaaaacaaaacaaaaaaacaggaggccaggtgcagtggctcacacctgtaatcccagcactttgggaggccgaggcgggtggatcacttgaggtcgggagttcaagaccagtctgaccaacatggagaaaccccatctctactaaaaatacaaaattagccaggcatggtggcgcatgcctgtaatcccagctactcgggaggctaaggcaggataatcacttgaacccaggaggcggaggttgcggtgagccgagattgcaccattgcactccagcctggtgacaagagcgaaactctgtctcaaaaaaaaaaaaaaaaaaaagggaaaaaagcaaacaacccaaaaaccgaaataaaaaaccaccctgcccccttgggctccatacaagggtaatttagtttgggaaagtaactgctaggtgagagtcatcagccatactttgcagtggcagggagcagtcaggtgttgagctcatttactagagtgaaccgcatgagggccacccagcacccacctgtgcaatgtaataggcactctggatgcatctgttgatcaacaacaccagccattagccacatcctcataacattttttttttttttttgagacggagtcttgctctctcatccaggctggagtgcagtggagccatctcagctcactgcaacctccacctaccgggtttaagcgattctcctgcctcagcctcctgagtagctgggactgcagatgcgtgctgccacgcccagctaatttttgtatttttagtagagatggggtttcaccaaattgtccaagctagtctcgaactcctgacctcaagggatcctcccgccttggcctcccaagtggtgggattacaggcgtgagccactgcgcctggccgctcatagcatttctgagatggtggaagtgttctgtatctgtgctgtccaatacagtagccactcgctgcatgtggctatggagcatttgaactgtgcctagtgtgactgaggaactgactttatttagttttaatgaaaatagccacatgcggctagtggcaactgtgttggacagcatagccttgggggaagctcagcatttgtgagtaaaatctccaccgttacccctctgtctggggtgtcctgcgatgctgctgcggggcaggggaacgctgagctagggcagggttgggacagttgctgagatagtgagcagctctcagaaacctgaatctttttttttttttttccaatctttttagagacagggtcttgttctgttgctcaggctggagtgcagtagtgtgatcatacctcactgcagccttgaactcctgggctcaagtgatcttccttcctcagcctctagtagctgggactacagtcatgtgccaccacacccagcaaattaaaacaaaacaaaacaaaaaaactattttagagatgggatcttgctatattgcccaggctggtctcaaactcctggtcttaagcaaacctcctgcctcagcctctggagtaactaagattataggtgtgcctggcccaatgaaaatctttattcctaaggtttttataaaagatcaaaggcaggagaccagaattcagtaagagggggtctctttaattgaaccctaaagcaaaggctacttgtgagccaagcaaagcatgggctggctggctactcaggagtcaagcccagctcctggtaccgtatgtcctagaaatctactgcctgctctgggtaaagattttttcattaaattgcggagcaggctgagcatgttggctcaagcttgtaatcccagcactttgggaggccaaggcaggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctga

SEQ ID NO: 1585 - DNA, 24226 bp, Homo sapiens
acagatgtcttgggatctttaacatttgggatgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacaggtaagcgggaaaacttcggggcacccagtgcgggtgaactggggcgggggatcgggcccctgaacccacggtcttcagccttagcggagggtgccctacagggaatggggtaattttttcaaaggggcaggaattctgagttcctaccaaaaatgcacatttccagtccctcaacctttctccttcgaccttcttcgtgcctgtggatcttcctggccaggttccgggaagccagaaagcagccaaacaaaaggagcaaagtctcgggccagcctggatgtggagggcgcagtgggggaggggagcagggtggacaggacaaaggggctttttagagaaagcctagaggtctcatttcagggcgcattccaagctggcttggagttcccctgtcccagcccacttcacctttgcttagtggaggcgaacacctttcctagtgagcagggagcagacgcgagtaagaaaacagtgaaggaaccatctcctacccctcttgcctggagggtcccgggctatttcacttcttccttttttcactgttgtctctagcgctggccattgattccttaattcttgaagtaagattttagcagtgcctgagactactttgctgggggctgttggggatgtgaagatggtaggacgaggcccttgctttaaagaacttccaatctggtgttatcagaagaccctaaaagaaggaacttttttttaaaaaaaatggagagtggatggctacagcgctggggaagagttttctgactcgggacttttcctcaggaaacgaaaacactgaagaggtccagtttctcttccctggggaagggctcttgtctgcaaagatcagattccaagtactataatgttttgcaaggaaataccacttcctcaccaactggtggtctggacggcactctggggtttggggctggggcatcagtcccctgactccccggcctgactggagtggggagctgtttcagattcccagctggcctctggagtgcccacctcccccattggtattttgaattgaatgacatggccatcagagagctccaaggatggctccccggggttcttggcaggaggtttggttagccagctcccttccaaacctcagattctgcaaggttgggaaatattgagcgtgaatttgggggagcaaggtgtttttgagaattccaaaggatcaatgcaaacagtgagattgagcatctgtactaacctcccctgaagtcagagatggaggattacctgagggcagggattcttaactgggttcattggcattaggcatctgtagatggaattcagaggatgtgtaaactaggtgaggcaaaaaaagatatcattgtttttcaccaacctttaacagattttaacatcacctttagttatgaagacaacaaatcacagtagcattggcagtacctgtgactttgccattaatagaattcatagtttcatatcacactgcagtcacagcagtcttgaaatgttgtttacactcagcccttgtgtgaaattacccactgctagaccctgcttaatgttaataaagaagcatatatattgctatgtttttatatttttagaactttatttcatataattgacttttttagtgatcttcttaattttattttatgctcaagaaatgtgaactgtgagccaattcacagctggtagaaacttccaccaacccccacctggagctggagatgggcaaggtggaggaagggccgcttatgcccagagtcaacccctctctgtttgactttgtaagaaagtgccaagcctctatggggagggacggtgtgtcacggaggactggggaagggcagggctgcaggctctttgggagacccagagaacaagctcccaatggggcggggggaggaagaactgtcccctcttagggcccctcagcctcagcctgggcagaaaatgaggtggtcagcctggagcactctggggctagcattgtttggaaaaagggtgtgtacaggaatgtgaaggtgtgctgggtgtgtgtaccggagcagtgggggatgctgggggactccagccccatgagttccgctccacaggagatgcctggtgaaagcaaacttcctctgtcatccctgcacttgggggtagggagtggggacaggactttttaggggctgggggaggggaagcaatccagacatgtattgaggcactggaatctgggtcgggggaatggtgggaagatcagagagtggggggaaagggaggtggtaagatgaagacttgaggggtgcagcctgctggggacaggccaggcaacagtcagcgttagctctgcttccgccttgaaataggctagattccagtttcccatttgcttgggggtcggtgggatgggagatcttgaggcttattttttataggaaataagttccattttggtctctggctccttgcatttggggagtggacttagggtctggggtcacagtggacctcctgtggagtaggaaacaggacttgggctcaggtcagtgcctgtcagtgccccatgaacatgcgttgctgggggatggatgtaaataatcaacagagaagtgatggcctcgatacccttgggggacaatgtctgggataaaaagaacagcctgatcctctctctctaggattctagaacttctgcatattggaattccagctgccttgcctgaggttttaaaatcctcactcgggagagataaaacccaggccttggtcttcatttccatatgtggggaagagcagtgacccatccctgtcagtttgtaaatgtcctgcttgttttttccatggacagtggacatttcaccttgcttccggggtgcttaacaggcctcaatttctggaaagagaaactgaggtcaaaggaaggcagggagagccagggtcaggacaggagggcacgcaggtacctcacagctcagaatgttgtactagggtctcttgaggccatgaagacatgactcttgttgttgtcttctttggggattcctccatgggagcccctttttccctgctaccctcctgccccccggaagtgcagaggcccaggagctgcctgctggcaccagttgcacgggattagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcaggtgagggcgggggaggtggaatgggtctttggggctgagagcaggctggcctgggagtggaggagcccaagcagtggccatcacccccctccgacccccacccccgccagcctatgtctggtgtgtagggatgacagaggggtgctggtgggcttggacgggagcctgttcttgtggttgcctaggccttagtttccaccagagggagagcaagcagagatgagctgggacaggcaggcctgagacctggctttgggggacacacttgggatagaggaggatcccccatggcccggcctgagggaaggtgctctggagtttccctccctccctctgtgccccttctggtctcctctgcctttttctggggacattgttcagccgggtgggctgctttttagggcccagtactggagcttgaagaggcccaggagggatccctgtgttagggagggggtggggatgttacctgaactgcctttatctaaaagcaatgccttagacacttaagactcatagcctcctgggtgggggtggtgccctcgctctcacctgttgactctggggcaggttccctacagctgtggagggcggcctcggcagaggcagatgtgagggtccgctatgtggctgtacgggtttccttcttggcctgacattgaccaagaggtcgagattcagaccggggacctggaaaggctttagacactgtgcagtctttattgtgcacaggaggaaaggaagccccgggaggcctggtgacttccccaaggtagtacagaccgcagcagaaccaagccttgagcccacagccaggggctctgggcatctgacgctgttctctttgctctacttggggcagcaagtcatcccagagaggacccagcatcaggctgggaccactgggaagatcagtgcctcccctttgatgctggcagtcagagactgggctgagctgggagaaggggaagctggcggagacgggaggcgtgctaaggtacccctctgtccctgtaagtccccactcctctgcaacagtctcagagcccctgagaagcaggggctgagttggcccaactttccaaggcaactacttagtggttaataattaattagcaagcgtgactaattaatggcttcccctcccacattacttcctcctctgtgcaaagcagacacactcagcatgctagctgagaccaccttgcttcctacctctggctgcaccctgctcttggcttctggggagggtgggaggatggctagggtgggtgggaaggggtgggggtgagctgcctgctcctctgtcctgttcttatctctacgagggatagagtttgggacagatggacagtgcagagctaatagtcatcctaagtatcctgcggggtggggttccagaatatatggccaatctttcagaactttggcatgtttgcaaaggcctcccataaagttaaaaaaaataattctcccatgcattctctagacttccttgaataattgaaattccaaagtgcaaggtacatgttgctttcagggctttgtgtttgattgttgctgcctgtggttgctgtgttgtttatgtaggtctataaaagttcttgatcgtcctgctcttatcatcttgatgggtggagaggtatcaccagggacctggctgacagcagtcccctctccctgttggccttgctttgttaccagctttcccaaggccgacttttctgtcgtgttggctgcctgaggaggggtggagctcacctcccccaccctgcggccccgcgctctgaggaggcaggataggctccagacagaaactcggaaggacttttggactcttgctcaatgggctgactcagtgaggaggtggctgagctctctttccagacccaaccacctgcatgggctccgcccacccctcccacccctgctgcagccagcagctgccaggccctggccagctgggaccccaaccaggggtgtgggttggtgaggagggagagggggtgggcacaggtgttatctgggtgactggtccctagctgagccgacacaatgggatggcacctgtaccacccaagtgttctccaccccgaagcaggcagaggagcaggtgatctcctttctgtccttgcacagcttctgctctagtcactgcttgcccctctcctgtcaactcttggcaaccctgatagacacagccctgggtctcccctggctgtggggtgtaggggatctaggctgattccccttcagtggtctcccaggagtaattgatggcttgaaagttgtttgagggctttgggacagctctctggcatacagtggctgcacatatctgcagatgatgtgaagttcagagtccagggcgccaattcagagagtgggcgtcctggacttcggaggccccagaccagggccttggccatgtgcctgcccacttcttgaagtgtcctcagccactggggcgtaggacatgcctcacacctcctgggttcttgggttgaggatagctgtgtcccataaagatgtcttccccttcctcctttcttttttttttggagacggggtctctctgttgtccaggctggagtgcaatggcgtgaacatggctcactgcagccttgacttctccaggctcaggcaatcctcctgcctcagcctcctgagtagctgggactacaggtgcacaccactatgcccagctaagtttcattttggagagatggggtctaagttgtccaggctggtcttgaactcctgggctcaagctatccttctgccttggtctccagaaatgctgggattacaggcgtgagccaccatgctgggcttccttcctcctttctttgttatcccatcccattttttgtccccttcctttttatcctgtctctgctcttttccttcttgcccttctccccagtcgagcggttcttgtggctaccacagctgtcgacccccttaggcctagaggactttggcccagaggggagttaggctgggcccctgagagcccactgagaacagggtttgctggtgaggcccacagccccttctctaggtcagcacccccagtgccagaatctcctgccccagatggttcctgaagcacagtcctcccttccactcccctgctctcaagcatctattcagctttttgtaaccaagatggttcatatctagcttttttgttattgttctcttttctctttaaagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggtgagtgttcagggaaatccccctgccctagtccctagtccctggtccctggtccctggccctgactcctgagtcctgagccctcaggcactagggctggctgggctgagactcccaagggctgagaggaaggggagggagaggcctctgctgggaggagggggaggttctggaagggctggagcctcagggacatgtggagttttcctccctggagaaaactggcttggagttttggttctatctggaagagggatctgcaatgttcaactttagccccagctgagaagttgaaaaatctcaggcaggcacagtggctcatgcctgtaatcccagcactttgggaggccaaggtgggcggatcacaaggtcaggagatcgagaccatcctggctaccacatagtcccagctatgtgggaggctgaggcagaagaatcgtttgaacctgggaggcggaggttgcagtgagccgagatcgcggcattgcactccagcctgggcgacagggcaagactccgtctcaaaaaaaatatatcatctggccaatgtgaaggtcttgcctctctgtttggccagacctgtgggcctagtctggcctagtcttgacagaggacaagaaagaagaggcttatgtgtgtgtgcaagagagaggggtagtggggagagggagagagagagacaggaagaagaaggagaaggaaaagaggaagaagaagggaggaggagtggggggaggactgcaccggcagaactccctcccctgcactcccccaccataggtcacctggtgggacgaccctcccttctgagttgtaacatttgtgcagccaagagacgtggtgttttgtggctgtgacacaggccacagcagccagcctgcaatttgtgggcaggcatgagatgtgtgtgtgtgtgtgcatgtgtgtgcatgtgcattcccctaggggtggtcaataagtaacggaggaggcttccatcttcagcctccctgagcatgtgccccccaacccttgcaggccccgacagcccggtctccccaatgaaggagctgacccatgcagtgcacaagcagcagagggccctggaagcgaggctggaggcctgcctggaggagctgaggagactctgccttcgggaagcggtgaggccccagccagcacacacaagcatcgggttcatctcaggagctgtggagccacgtgtggggatgcgggagctggggagagggagccccattcttgagggaattctggacatcaggctgggggctggggcccagagtccccatgatgcagtgtttgaccttgtgctggatggagaagagtcagacccaggcaggggcccaggcacagagaacaaagttcatcaggggctgcagagggactgcacagacataagtgcatatgagtgctgtaacccgggtcggtgtagctctggaggaagtgatcagaaagaggtctgaagggaaaggggaggagtgcagagtgggtctgaagacaggagagacagtgtggaggatgggatgaggtggggtggagggtggtcccaccagggcttctatggaaggcaggcacatgcagtgcaggggccagtgagccaagtctgggcaggtggagaggacctggctggtctctgcttcctccccaggagctgacgggcaccttgccagcggagtatcccctcaaaccaggggaaaaggcccccaaggttcgccgcaggatcggagcggcttacaaactggatgactgggccttgcacagagaggtgaggaacctcaggaagctgccagtacccctcgatccccaaagctgatcactgagacgccacacctcagctcagtaccctggcaggttcccttccaccctttcacacccagtgagggtgcttggctgcctgttggtgagagacaccatgaatatgtagcccaaatggctgtggagaaggggcgccactaaggaaccgagagctgggagctcaagggaggacactgggtttgaccccattgggcagaagatcagttaagagcaccagccaccaacccagcgggcaatagcctgctcagacaggttactctggcccctagggctgtcctcctttctcaggaggaggtgggggcagtcaggccctgggtgcccttcccctgtggcgtcaatggcagcagtttcccatgggccagcctgccccaccctttggggtcaggagggaaagtgtcccacttgggttcccaccctgcccggttcagcaggtgggctggtgggtgggtgcccatgccagcttttcaggctgacaagtttgcttttcggctcctcccactccttcaccctctgctccacgtccgtccattggtgctgctgtctgcctctcttctgtcctcagggcttaggactgggacctagagcactgtgtcagggctgctgtccaccctctgggcccccaatctccctgcctctctctagcctcactcctgccccctctctcaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgaggtgagccggctgccctgaggggggccatgctccttaaatgagcttttgagggatggtgggcgcacagccccgtgccactgcctttgcatttggctccagctgggtaaagctgattcttgggttcagctccaccccatcctgattctctccaactccagcaaggcttccccatcctgtgaggtcttcttctccgtctccttagaaaacaccctactctctccttccgtatcctcctcaaaatacactaccttcaagagacttcctacacagagatatttctcagctgaccctgagctgaatccaaggtgtattcaactgggtagcccaggctggccccgctgccctccaggcccacagggtgatggcatctctgggtcagggtagtgtgaggctcccgtgagcccaaggctctgagttgatgtgtagtcccctggcctgagttaggcagcaaagggtttgacgattgctatgtgttactgatcactgaattgtttcaggggcccacagctacttaggagatgttcaggttgaaatccagcaggactggtgccacaccccacagccccttaagtatctacaaccaccctggtcaagggtgggatccttccatgtctgttctctgccctccttgtgtctgtagttcaatccctgagctccttggcccagagactagtggccgtgggggcacctagtgagttgttgatgcccaggtgctgccacatcacatcagtgtgtccaccacaggttagcttccaacaggtggttctgagcccttaggtgtgactgttttcctttgtcctgacccaaggccagcctgtcaggtcaggacttgcatctctccattccaaaccccaccgcagcaggcccatgactcagctctgccccccgtctctcacatgggacccagacctccctggctgcctcagagggaaccgggagggaatgaggccgtggccctgcaaaaaaaaatccagaattggattcagaggtctcggccttcattcacattctcaggctcccatccctgcatatcgtgttggctttttgccaagactactcctcagcctgggagcagtcatggggaagctggaaagcccttgctagtccctgtgccctgcagcctatgcctcaggcagggagttatctcagcacaggtctcagaagtccctgctcctatccatggcttttaatttagggtagaaagtgcatgaccagacaccacccaggtcacctcccgcagccaagagtaggtgataaaggaggaggtgcctccatgtgacagttaacccagtaaactcagaagacagtggggctgacccagggaaaatggccagacctctgtccggttccagtggttctggcttggccgcagaacaacactcccagtctctgaggctctaatggaagacaagttctacaaccttactccactctcaacagggatcccaggacttgacagcaaccttgaaaggtagctgctgaattggacatggaagcccctaagggccaacttgctctgtgcctgcagggagaggtcagggtggtgagatatgcccgttggttgcagcgcctcctgctccccggtccagcctcacactgctcagcagcctcccctgcccaccggggctgccattgctgggagcttctgcccatgatgggtggcaggggagtgtcaccctgatgctgccattgtgacccataatgcttcttgttgggagtcgggagcaggccaggactggcctggggctctgtggaaggcaggaggatgaggttctgaaaccttggagccctcagtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaagtaatttctgttttgtggctcctctgcccagccgagccctcctagaaaggaggaagtaaagcagaattattagtagctgaggtgttttgaattaaaaagggaaggccggacactgtggctcatgcctgtaatcccaatacttttggaagccaaggtgggcggatcatgaggttaggagttcaagaccagcctggccaacatagtgaaaccccatctctactaaaaatacaaaaattagccagacatggtggtgcatgtctgtagtcccagctactcgggaggctgagccaggagaatcccttgaacctgggaggtggagcccaggatcaagggagccgagatcgtgccactgcactccagcctggcaacagagtgagactttgtctcaaaaacaaaaaacaaaacaaaacaaaaaaacaggaggccaggtgcagtggctcacacctgtaatcccagcactttgggaggccgaggcgggtggatcacttgaggtcgggagttcaagaccagtctgaccaacatggagaaaccccatctctactaaaaatacaaaattagccaggcatggtggcgcatgcctgtaatcccagctactcgggaggctaaggcaggataatcacttgaacccaggaggcggaggttgcggtgagccgagattgcaccattgcactccagcctggtgacaagagcgaaactctgtctcaaaaaaaaaaaaaaaaaaaagggaaaaaagcaaacaacccaaaaaccgaaataaaaaaccaccctgcccccttgggctccatacaagggtaatttagtttgggaaagtaactgctaggtgagagtcatcagccatactttgcagtggcagggagcagtcaggtgttgagctcatttactagagtgaaccgcatgagggccacccagcacccacctgtgcaatgtaataggcactctggatgcatctgttgatcaacaacaccagccattagccacatcctcataacattttttttttttttttgagacggagtcttgctctctcatccaggctggagtgcagtggagccatctcagctcactgcaacctccacctaccgggtttaagcgattctcctgcctcagcctcctgagtagctgggactgcagatgcgtgctgccacgcccagctaatttttgtatttttagtagagatggggtttcaccaaattgtccaagctagtctcgaactcctgacctcaagggatcctcccgccttggcctcccaagtggtgggattacaggcgtgagccactgcgcctggccgctcatagcatttctgagatggtggaagtgttctgtatctgtgctgtccaatacagtagccactcgctgcatgtggctatggagcatttgaactgtgcctagtgtgactgaggaactgactttatttagttttaatgaaaatagccacatgcggctagtggcaactgtgttggacagcatagccttgggggaagctcagcatttgtgagtaaaatctccaccgttacccctctgtctggggtgtcctgcgatgctgctgcggggcaggggaacgctgagctagggcagggttgggacagttgctgagatagtgagcagctctcagaaacctgaatctttttttttttttttccaatctttttagagacagggtcttgttctgttgctcaggctggagtgcagtagtgtgatcatacctcactgcagccttgaactcctgggctcaagtgatcttccttcctcagcctctagtagctgggactacagtcatgtgccaccacacccagcaaattaaaacaaaacaaaacaaaaaaactattttagagatgggatcttgctatattgcccaggctggtctcaaactcctggtcttaagcaaacctcctgcctcagcctctggagtaactaagattataggtgtgcctggcccaatgaaaatctttattcctaaggtttttataaaagatcaaaggcaggagaccagaattcagtaagagggggtctctttaattgaaccctaaagcaaaggctacttgtgagccaagcaaagcatgggctggctggctactcaggagtcaagcccagctcctggtaccgtatgtcctagaaatctactgcctgctctgggtaaagattttttcattaaattgcggagcaggctgagcatgttggctcaagcttgtaatcccagcactttgggaggccaaggcaggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctga

SEQ ID NO: 1586 - DNA, 1086 bp, Homo sapiens
atggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggcgctaggcggccgctggccgttcggcgatggcctctgcaagctcagcagcttcgcgctggcgggcacgcgctgcgcgggcgcgctgctgctggcgggcatgagcgtggaccgctacctggccgtggtgaagctgctcgaggcgaggccactgcgcaccccgcgctgcgcgctggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtag

SEQ ID NO: 1587 - DNA, 25703 bp, Homo sapiens
ttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactag

SEQ ID NO: 1588 - DNA, 930 bp, Homo sapiens
ctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccat

SEQ ID NO: 1589 - DNA, 15504 bp, Homo sapiens
gttacataaactactttatttaaataaaaccaggaaagaccctttcccccttacacaccagcacatgcacacacgcacacccacaccctccctccctttcggctgtctgcccatggccacctcaaaccccgaggttctcattgtgaccaacctccctcaacctgtagacccccgtgcagagtccagttgcccacgcatcccggttgctggcagaacatgggcctagaaaagagcactccatcttcctggggtgggtcaaaaggaaggactggttctcccaaggcacccagatctggtgtggcttccctacaaactgggagcactgccaggcagctggagctgctccctgcggagggcagaacttttcaccccaagccaacccctccctgtaacaaaggaagtaagagggttggcagccaagcttcagtgtgccccgagggatcctgcagtaggtattttcagtttggggaagagcaagggagagcaattgagcaccaaattccctaaccccgtcctgcaggagggtgctgagtcagttcagcatcctctacccagaaaaagtaaacacaactgtgcagcaagagtgagggtgggaatgacaggggcctaagccttcaggacctcatgacttcacccccaacatgggccctcttagggacccactagcaccttggcaatgttgaggacccagcccagcggaaacaccatacccacaggagccagtctggagttggtgatgctccctatgttgacagtggggttgggtttctctccctgacaccagcttcctgcaggccctgtaagttctgctttggggcacacatcgcagagtgcctcaggtcatgaaagggaatgctgaagggaaaggtggtgtcttccggaggcacacagtacatcttacaggttacacacgggcaggctggagcaggacggggggcagggctcagcagcatacctagggtaccctccagagttgccttgggaaggggggcggggctggaaaccaacgggaggggtgactgtccatcccctccgacgggagtactcaggcccagcacccattttctctgatgagcttcccagtgccttctagaccaagttccctgagggaaaaagccaaacagatggaaagagagggagcagaaagggaaagcaaagggtcaatgccctgcagatcgtgatgagctggcaggcagaggcagacagagcgccgagggcgagccttctgaatgggtaaggcaaagagagccgcctgctgaggggaagggggaggctgtgagaacgccagggcaggcacagaggactcgaacacagctggcctctcccagggaagcactggagaaggggaccttcgggaagacgaggccccagaggagagggcgtgagaagactgtgggccccaaccggcccgtggtggcagattcaagccaggaaccctggcccctcggctacaggctgacgctgcgctggtgccgacccccacgggctccgccgtcgctgccccggcgccctccactccgcgttcccagctcttggccgtccagactgacgtggtccgagaggcctcgcaagtgctccacggagtcgcacttctgcaggtctgaagccaccgtgcgcaggctcagcagactcagggtatcggtgtcgggggcggggccgggccccaggctgctgccctcctccagccccgcaccctcggccccctcaatcccgctgtctccgtcctccatgtcctcgggtcctgcctcggcccccacgggggaggagcgccgagggcccagggggtggggaggcagacccccgcggcgccgtgcgtgaatctgctcgctgatctgctccaggttacgaagggccacggagtagcgcgtcttggcctgagctacctgctgctccagttctgtcaccttggccttgtgctcctgcagagggcagagcagagcaaggcgacccatggggcacgtctccaccttcctcagcactctgcactgaggtctgagggcctgctctcccagaatacctggacagctggctcagcatccaccacagacccacaacagccttccctgctccactctcagcacccaccacagacccacaacacccttccctgctccacttgctctgcgttgttcctccccagcaatcctgctcctgacctgagccccaccttccagagccttcctctcaggccttcctctccaccagctcctgcttcctcatcctctccccactgttccctttcacccaatggctggttcttcttccccatcccagatttccaccagttcttttcctcttgtttacctcccttcttccaactacgttctcgccgtcaccagcccccatcaccagcccccatccctgcctctcactcctgcaaggtcatttggaacatgtgtgccaccacccttccccaccgctagccggaggcctcaccctggccacctcaccaagatggcccagagaggccgaccagcatcccctccagcctgcacccccacctacccattcctcctccccctcacccactcagctacctccaggatctggctgaactgggccttgagctcaaagtaggggcggctcttgccgatggccctccggagggtcttctgcagggcttggacccgagcctcagcctgttggcacagccgagtcactcgctggtgctcccgctcacctcgaagccgctcttcctccgcctcattcacctggcccagaggacacatcactgagccaggacccatgcttcagtctctggcatctgccccaggctgccaatctgaacaacgccctggggggaacccaaacaggaacatcctctgcaaacccccaactgtgtacagagcccgagacacgcaggggaacacggggtctatgagcctcaagacagcttatttctgtctctcttggatctgctgcctgaccgtcgaggaccacatcacaggcacatgcctctgagccacgtcttccccatgttcttgcctagtgtcacctgcaccactggctactcagctttgctgctgccaggaaagggatgctggtgcccactcaaccacttgagagcatcaggggaatgtctgtcagcacatcacacatctgcagcagccattctcttcagggagccctcagcgccaatggttagggatctgggagtgagaagagcctgtgtggggagccacagctgtgcgctgggttctccaggtttccacaccctatgtgggcaccgtccaggacaagtgggccgaggttggatggggctctggcgtgcttctgctcagggtgttgtacagttggcccacttgtcctggtagacaaagcggctggagccctcacctgctccctgttcaggtgtagctctacactatacaccatcccctaacccctccccccgtgctgtgtgctctcatttgcatgagctctagagtagaagtgaggtgcctgttctgtgtgaggggcagatgaagaatcacaagccacaaacaccccctcgagttgctgacacctgccctgtgcaagctgaaggtggcagacagggccaacggcagagatccttccgctccccagtcccctttcaggagcttggaaatgatacataaattatacttcaaaactcgaggtgtactgtcagagctcaaaagcaggaaagggagcagactctgaaaacagaagcgaggagtcacacagctaaacataataaaatgtgaatgttgaatcctcagtatccaccagggatgaattgtttgggttagtcccacacctggaggcaaacgttcaagaagagcccgggatgacattctaagtcagagggaaatggaatatgggaagcaatggaggccaaacagaacagaaaactaggaacaggttttgcctgaaacagaatcaaagttgaaagaaggctagaatagagggaagaatgaggaggtgaggtgataaagacatagcaaaggatggacgagaaccagcgaaggggacctgctggcaccgcccggctcaccttgcaggtagcatggttcagcatctcctgccacgtggggtccagtcggttcttgtcagccatgacgccctgctcagccacaaacaccatttctcgagcagcgttgtgcatgcttacggcccgctcgtaccgcagcgctgccttctgtgtctcctgctgagcctggggggagagggatatcaggatggggaaccctgagggaccccagctgcccatggagacccataatagacgtgaggataagagaaggaggaaggcctactagcaatgtcggcttcatttcccaaactgtgctgaggataaatgccaaggaagcaacattctataaagaatatttcataaggatatggactagaagaaataaaaattttgccagtggagggtagatgtgtgaaatccagcactcccaaaggctgctagccttttcccctagggaaaacaaaggaaaacacaaaccattttagtgtaaggtggttagcaacatagacagagtcttacagaaaagatgaccttgagaccatcaattccatgttcagcaggcaagctgaaggaagtaatcagacaagtgctcagggacagtcatcatagccataccaaccaagcaaaaaacaaaacaaacctaacttttcagttataggacatcggttaaataaataatagtacatctaatataagaaaataagctgggcgcagtggcttctgcctgtgagcccatctacttgtgaggctgagggaggaggattacttgagcctaggagtttgaggttacagtgagctatgatcacaccattgcactccagtctgggcaacagagcaagaccccatttcttaaaaaaataaaatattaatcagtcctttaaaatgacggcttggatgtatagttattgacatggaaccatgtcataatgctaataaaagaacaaaatagcacatactgtgtaatcccattttggctggatatacaaggacacgaaatatgattaatacagcacacatggttatctgtgctgtattaatcatatttttattttctatactttatgatgctttcatgtcttgggggaccttgctggccaaggacaaactgccccttccagggctaattcctagaaacagtaaactcccctgtaagtgtgcctttcatatgcaaaccaaccacctaatccaaagcctggatccccagctaactcctttacctacttctccccgaccaagccgatatttcctctgccctaagtcatcccagggccaggtactagacaattagaggccgcccctatagcccagggcctagcaaagttattccaactatccactcctaaacttatccaaacttgcctaccctgcctcacctactcctttccacgaaaaccacactaaggcgctgcgctttgctttctccttcacttctgcctcctgaaggaccctggctgcttccccgtgtggccctgcatggcatggatgtcccctcctctcgggaacaaactcttcttccaaggcagttgtctgtatctgtcacctcaccatacaggatgacaacaaatcccaggaaacaaaatgcatgaaacgtgcatggtaggattttgggtgatttttgtttccttcttgttttattatgtttttccaatggtgaacacatattatttgttaaaagtaatttgttacagaaaaaaggggtgtgggatggggaaaagagtgaggagtaagcaaagaaaagattcagaagagagacatgaaccaaagggaagaggaaatgggcgcagatgaaaacaacaggatgttagaactgacatatctgatataccctaaagcctgattcctgatacacagaaggcacttaaacattagcagggctgaactaaatattctcccacagccaccctcaccattttatagaccataagcccagagcccacgtggtaaaggaacctcctgagcccacagagctggttccgaccagccaggtctagcccagggctctgccctcagggtctggtgttttgtctctcactccatatagagacagaagaatccagggccaggctcagcacgtagccttcctcaaacgtggtcagccagccatacctccttagccagccgccgagcctcatagtagggccgggctttctcgatgcagctccccaagtgggaaccctgtgtattcagtttcctcgccgactcctgtaggatcctccgataggtggtcctggcctcctggaaaggaacaaggcagaggaaaggcacatgtttgggtcccagcccctcttgtttctcagacacacccctcccaccgccactgcctcaatctgggaaagagacagatggagatacttccaaggaccagcccaagcacataaggaaaaggacactcacatccagctgtagttccacctggttgatctcctcgctggcctggttcaggtgctccaactcctcctgccacagagaggggtggcaaattagtgcagtggaaggaagtagccttgaatgaaccatgcaaggcaggagcaacacagagagagagagccccacttgcccagggaaatgaggtgagacactcaggaaaggaaagaagatacggagattgccaaaagctttcttgtctatcagggacctgatacatacaatctcacgtaatcctcacaactctaccttgtattgggtagtaaaaccccagtttcaaggatgaagaaattgaggtttggagaatgcaacactaatatgcacaacgtgaagttgtggtgagccctcactctctccgtgagattgcaacacttcctcaaactgagggagtctccttggacctgaaggctcgctctctgcgagaggatggccacctgggccagggcagggccactcagtcagcacatgtttactgcacacttatcacctctcaggaccgtgagacctgagaattcaggacatagaggtggcagcctgtaaggaaacccagcaagtcagcagcaggtcctgggcagtatgtgcagccttgtgaggggtgggtgtgggtgctctctgggtagcaaggtcacctaattgggcagcagaaggtcagggtaggatgcctggaacacttgctcagcagctggaaggacttcatagacacaaaagtgccagtgaatgactaggcaaggtggctcacgcctgtaatcccagcactttgggaggccgaggcaggcagatcacctgaggtcaggagtttgagaccagcctgggcaacatggtgaaaccctgtctctactagaaatacaaaaattagccgggtgtggcagcgtgcacctatagtcccagctacttgggaggctgaggcaggagaatcacttgaacctgggaggcagaggctgcagtgagccaagatcacactactgcactccagcctgggcaacatagcgagactctgtctcaaaaaaataaagtgccagtgaagaacaaagggccaaggaaccaaaggggagcaggtaccctgggcagacaagttggcaggtgagaaggtcagtaaggctacagcactatgggaggtagtaccaggactttctgcaatggcaaaagggtctctcagagcctggtgccaatgtaacgaaagcctgggggagccagggagacaaaagtggaggctgggacaggcatggtggctcacacctgtaatcccagcactttgggaggcagaggtgggcagatcacttgaggccaggagttcaagaccggcctggccaacatggtgaagccctgtctctagcaaaaacacaaaaattagctgggcgtggtggcacacatctataatcccagctacttgggaggccgaggcacgaaaatggcttgaacccggggggcagggattgcagtaagcccagatcgtgccactgcactccagcctaggcgacacagtgagactccatcacaaaaacaaaaaacaaacaaaaaaaaaaaggtggaggctgtctatagtattccaggtggcagaggagagggcagatcccaaggcaacgcaggacacagaatcacaggggcttggtggatgactaaggtcaagatcaggaaagtgtatagagtccaagaagccttttggcctgcttgggcaatgggtgaccatgaccgcaggtccctatagagcagatcctgtgggagggagggagagtcctggggaaaagttgctggacaagctggtttgagtgccttcctggcccctggaaggactggagagagaagcaatagaaccatccagggctttccatgaaatggaagagagctgagaggggtactggcctcaagtcatcctcccttgcccgagaaaacacaaaagttcccagagcccctggtgagctaaggacactactgaggagcagtgctggtctgtgccaagggccttgtgccaggaaatacctggtgcctagctataggatttgccttcaccagcccctgctgtctctggacaggaggctggacaggccagagagacccagcccagcatgtgcctgctgcccagacccatgacttgcacttggcagtgacaccacaatcacttcccactcatatggccgtgatgttggcccccactcacctcattcgggcctttcagcaacccagtgagggagtcaggctgacatgcacaatcttccttttagtcccttctacctcttctatcctccccccatcccctgccttgatcctgaaaagatctgggtcagcaggtaagaatacaggaaatggtttgacatgttaattacagtaacaggaagaacacaaaggtagaaacctgtaatggaacgaggaatgaggatatgaaaatgcacacacctacctacaacagtgtagaccctgcctaaggagggccacaaatctggctctaaactagggatgtccaatctttttgcttccctgggacacactggaagaagaactgtcctgggccacacataaaatacactaacactaactacagctgatgagcttaaaaaaaaaaaaaaaaatcgtgggcaggcgcagtggctcacacctgtaatcctagcacttcaggaggccgaggtgggaagattgcctgagctcaggagtttgagaacagcctgggcaacatgatgcaaagcccatctctactaaaatacaaaaaaatagctgggtatggtggcacacacctgtagtcccagctactgggacggctgaggcaggagaatcacctgaatctgggaggcggaagttgcagtggtctgagattgtgccactgcactccagcctgggtgaaggagcaagactcagtctcaaaaaaaaaaaaaaaaaaaaaaaatcacaaaaaaaaatctcataatgttttaagaaaagtttacaaatttgcattgggccgtgttcaaagccatcctgggctgcatgcggcccacaggccacgggttggaaaagcttgctctaaattttctcgaagagacttattcaacagaaacgtaacaggagctgcacatggaatttttaattctagaagccacattttttaaaagtaaaaaaatttaaaaaaagagtgaaattataaaaatacatttaacccaatatatacaaaatatatttcaacatgtgatcaacataaaataatattattatccatacttttacttttttaaactaagtcttcacaatccgtatgcacttgactcttgtgacacatctcaacctagacagtggcatgtggctcctgtgttgggtggcgaaggtctagaagttgttgtatttgggtagatgcatctacagtgtcccacaacccagtgtccataaaataacaaccattctggaagaacaggcagccaacacagctcagggccccagaggaggcatagggtcagcatcaacactaccagacacatggaactccaagtttcacagtgccttccgaacagagacatcaccagcaactgacacgatcaccccaacaggccctaaaaaggcaatgtctgtcaagctgaaaggcaacctacctccctgggggcccagcttcctggggcttgacgaggcctacaggggcttttaggctatctgggagacgagtgaccagttctttcagcacctcctgctggaatattctttctcagcaactttgcatttgatagatgagaaacaaccaggcggaaaattagtgacagacttgggtctggatccaggaccgacctttgatctcactttccttccactgtgaccaccctcctgggaatgaggacaccactggaaggacatctcagtaaagaaagaagtgctgtaatctaggaaaaccacagcccacgtaggaaaaggacagggattggaaatgcaacaaacattgattgtggggggtcagttggtaaaggccaccctgcaatgttcatgtggcaaatcaaagtccaagacgggatccccactggattccatggcctcaaatgcttccagtcatcaacttccagctcctgacaagatcatcaatggattggatggctcagcataagttgttactactgttaaaaggacaagaagagctgttgctattggcaagtggcaggagtgggcattatctttctatatgggaactagcttcccagtggcacctccagcaatttacagaaagccatctgctgatgggatctgtcccctcagagtcacaaagctctccctaacaggacaagaagatgcctggggagcaaagcagcctggagggcaaggtcaccacaggagggagggggatagcccacctaggcgacacccagggaaaggctgagcaggaatccactgaggacctgggacagttttgggcagtcagcaacacattccatttggcctgcttcaccagggactcctggcactcagctgaaacggaatttggggaggacaaagtctgaatcaacgtgcatcatccatcagtgagccagcagccagcagggagggtgaccttcccagggcacagcagtcagattcccaggatgccaggacactgaatcaaaggcatggggactcaggctgcagatgctcccaccccacctagtgcagaccatcaaaagactcaaactaatggtaactggggccagggtgatgactgtcctgtgaaagctaaacccatacttctagatgaggtcacagaggttgcaaagtcaccctagagagtttggaaaggagcaggtaaacgagagcactcacatctgaggaaagaatgcaaccactaagagggggctgagaaagtcacagaacagacccaggtccatcctagatccacgctcctttcctcttccctccactggaaccctctcggaaagctgaggatgagcctggaggactcaaaagaactccactaagatcatgacaaggagacacagccagcagccttccctggagggacagcacgctccaggtaggcaccagctgacttccttctaacttccagaggaatcccaccataaatggccatggagctgcctgcctgcaaaggagccccagccccaggtcagacagggcctcatccgaaggacagccatttccgggagcctcagaaaataccgaaacaggcgctctacctttgggatatacctggcccagtggatttggctctgactgtaacatcagaatcccttctcaccccacccagactaagagaatccacatgtctggaaaggctcaggtaagggtatttttgaagctccctggtggctttttatggacggtggatggaaacccagtaaatgcactgagaatccagagaaatgaacacccacctaaagcactgaaacacatgatcagagcaatgtgcatggtctagtgaactgtcaacactcaaagggacctcgaaagacaaacaccccaatctcctcctcatcttgaaagcccaagcacagaagggcaaaatgccaccggcctcctccgtgaagggtgcccctcaagccaggctgcctctctcacacagcaagaagacactgactccctgctgaggtcagagcactggcgtacccacacctgtgtcatcaaatgagggaagctattactagacctttcctccctatacaacccacaacattccacaacgtgttgtgcagtttagcaagagagacgagggtctgctttacctttcctgcaccagcgacatcacaagttcactggaggcaaagtaagtcttacgctacctcagtgtactccaactctcatagagctcatctgatagaagagtcagtgatgacagaatattctatttatgcactgtcagtataacattgaggaactgcttttttttttttttctgagacggagtttcgctcttgtcacccaggctagagtgcagtggcagatctcagctcactgcaacctccgcctcctgggttcaagcaattctcctgcctcaaccccccaagtagctgggattacaggcacccgccacaacacctggctagctttttttatttttagtagagacgggttttcaccatgttggccaggctggtctcaaactcctgacctcaggtgatccacctgcctcggcctcccaacatgctgggattacaggtgtgagccaccatgcctggccgaggaactgcatttttacatgttaattttaattgattgtgtttaaatagccacatgcagctagtccaccctattagacagcacaatgcaagcatgactcttcctactactaccatgtgcctatgcagacactggaaaaatacataggagtagtagaggccaagtaaagagaccacagtggattctcctctgcagaagccttctctggagcagggcaaggaaggctgtagggaggcatataatgcacattacacagccctcctccacaagcaacagagagacagctctttcccaaagtgctatctacaaactatcaccaaggaacaagcaaaaagagtttgagaaagaactgtagacttgtgtcagagcagagcaagaatgagttgtgcaaatcagctagaccaactgctcactttacagatgaagaaactgaggctcagaaacgtaaagaaacttccataaaaatcataaatcatggggttggaggtagcgtgaaactcagcccaagacttttttcactacaactgatttcctcagaggatgataaatctgtagaaatagcaagaaaaattggctgttttcaatgcaatgtcaggcagagcagaaataaattactgactcatgccagaaacaaatggctcaccactgctccattataagcatggacacagtagaagaggaacccacacacacacacatatcccaggaacccacacagagagtgaaggaagaatgccaggactggctttgatttcttcccaactcactggagtaatccaataaaggtttgctgacagataagcctaggaatttgagccttcatatgttcttgctcacctacagaagagtcacttccacaacatcagagtcttggagatgtgaccggaacaaatggcagactcaagccccaaacatgcaggagcatcctggtcgtcacctgcccaagaagcttcctcaggaagtcattctcagccaattccctgaaacactgcaacccagctttgattggccaggcatctcttccacatggagttggtcttcctcactgactacccccaggtctcctacacaaagatctgcctgtcctaccaactagattgtagacactccaaggcaataaactgctcttccattcctttaggagacccactatcctgagggccaggtatgtatgttactaaggattggccacaacaaaagttacaaatccttgaacatatggggtttctttatagatctaaagttgatgctacctttataacactggaaaggtctcactgtttacaagggtgaaacacattatcagagcaatgtgggccgcacatccctggaaggtaccgctgagaaggtgagaaaggggaaaagattctctcactcagcctcaaaactgtcccccagtatcaaagtcatctcctctcacacagcatccctaactaaggtggcagcccctctgcttatctggaaagaagtacaacacacctaccctccactgacctaaagtgtgcctcctccatctactgccaagtgacactttgctccttcagtgaagctttcagcaatgcctcccaagcactaaggccaggcctttctctgcactccatcagcacttcagacacacaactcttttggaacttgttacattaccctgcaatgatttgttgacaaacttgttctcctttcctgccccagcagactggggacagagtaagtctaagccctcattcatccaacactcttcagggaggctggaatctgggctctccttctctccctgctctcagtgctctcacctgtattctaggatccagttcttcctcctctcttggggacaatttggcctcactgctgctgcttccacctcctccaggctcttctgcgactgggctcctagggacttcatcctctacaacttcaggccgcagctccccctgtggggtctcccgccctcctggaacctgtctgagctcagccatgctgacagggggagggcagagccctatgcacaagagaggactgacatgctgggaccagggccccagcttggggcttcctgggctctagatggccaggagaagagtttctcttctcaaaaggcagaaaaggtgggcacaggaagaacctcacactaggttagaggttgagattcaagttgtcagtggggttcctagagctgaagccttgtctgtgcaaaagttcttcccttcccgccacagggagtccactgtgacaaacccggagcaacagctccaaggcagggggcaaagggggcttggatcctggaccgaggcctgctaggaggagcaccattcgggagggtggaggcaggcgcctccaggctgtggtggcagctggagagagaaggctgggcccgagctgaggctgtaggatgagcgtctctggggagctgcagagaaacaaaggccaagtatatggtcatgtcagcatcaaaaccgcagccaccagccccttccaactctacagcctcccaaaaactacactctcaccacgcccccacccatgtattccgaccagtccctacctcaacttctctccttagccctcaaggactttagattctactcttcccccgtcccagctcctctcgacccaggccctcctcaaccagcgccttcgagactttcctctgcacccctaggctctcctccatctcctgtggtctcccgctcgtcccactccaccccagcccggctttgcgattcaccttgtaaccccgagccccaccccaccttctctgtccaacccgagacatctaagcctcccgtctccaattccacactcttccgcaatcccaaggaccctactcccgtccattctacccagccatgcgcaaaagccccccgcacagccttacctcagtttaccttcccgtccgcggagcttctatgctgcaaacaatctccccccctccctccccgcaacaagccgatccaaccaaaaacgaccaggcagaccagaagcggaaatacatcatc

SEQ ID NO: 1590 - DNA, 15806 bp, Homo sapiens
ggtggtgcaggaaaagagctgggaaagcacttgtctcctttattgaacatctgcagggggcacctctgcactgaccaggcagccagagaagcaagcaggcaggtggtggggggcaggggagcatggggcaggaagacgcccaccctcatttccagtccttgaaaaattgcttgaagatgggactctcatggccctgaggcagaatctccacctgcagggacagcgggggagaagtctggttcacaaagttgccacctctgcctctgcccaggaggacaggagggggccagagccagggaggagggtgtgggcgcctggcctgaatccatgtgcagtccaggctgggaaagctcccctggatgagccatgagatgagaaccaagatttcagggacacagacagaggcaacagactgcttcaagggcgtgggtgcacagtttaataaatgccaccaacggtagctgagccctgtcagctccccacgggatgacttgtggacactgtgctgcggcaggaggggtggcaccagccagggacaacggcccagaggaggagtacccagttctctgggcacccaggagagtgctgcccaacatcctctttgaaaataataagtattttgacattttgaaggattgagatgggctttcccactggatgggtctaagagggaggcctggttgttcctgacagtgcccaaggctctcctgcccttcctggccaatttgaggggtcaggggccacaggaagagccctaggaagagggctgtggttgtgcgcatctcctcacctgagtgttcggggcgtactgcatgcgcgagatgaagccctcggccacctgcagggctgcctgccgctccttctcattcgcttttcgccctagatcataggaaggagatttttaaaaagagcagggaccctctttagctgccatcccatttttcttgaggaaatttaagggagtccacagaagagccagcaatttttacaataaatggaccaggggtcccaagaatgccgaggggctctttggagatgtggagtcagtcccttaagaattttcccaaaccggcagcaccaaggtagatgaaaacccctcgtctgcccgggtctgatcatgcaaaactctgctctgacctgggcccctggaatatttcagggaggggaacaggtgttcaccctagcatcagactgtgaggccgcaggtctccttttcctctaggacccctcacctcttgaattcatcaagccttttctgaaaaactaaataagacaaagggtacaatttattatagaggtgatttactcccataatgccagcagggctacactggcctaacagttatgctaactaagcacttacaaaaatgaagaccccacgtaatccagtcatttctgctagcagtcctgagaactcaaactgctcattccaggcttttttatttttattttttctgagacgcagtctcgttctgtcgcccgggctggagtgcagcggcaccaacacggctcactacagcctcaacctcccaggctcaagcaatctgcccacctcagcctctcgtgtagctgggaccacaggtgcacgccaccacactcagctaattttggggggttttttttttgtagagaagtgatatttcgccatgttgcccaggctgccagacatttttccaaggaaatgataccgaaacgatgccgtgatgtggttggctctctaggcaggctataaaatgccatgaactacaatgtatctgaaattaatatgctggattccttcctctgtcaactgaccagctgcccccctacccatgagatccttctcttcctggcctcccaagtttcctgtttttcctctgatttctctttccatagttgttgggttccttgctccggtttatacatgcttctgtgggcctctgtgaacccccctctgcttggcattggttccatgggatatgtgccctctggcaggagagaaaaggcagccctgcagcacacgcctctcgctttccactcttttgctgctcccagctcctccctttcacttctatccctgctgagtttcagaagcaatactatgaaatgcctggtagcagctatctgtagatacccacctacttgtctgccttcctgaccaggctaggggctggcattttctccaccttggttgaccccacaactgggtgttgagcaaatgctattgctgaaaattctcagaccccaggcagagactgagaacaagtttgtttcattttcagtcaaaccaagcagaacaggctctgcccaacagtgtttctatttccagaagatagaatcttttggaaaaacaagttctacaggttcaccactcactgcataaaatgatgtttaatttgtctaaaattcatttctgtcaaaccttgagacagaatcccaggatcaggggtcccagaagccccaaaggtctagagctgggctagggcagtggttctcaaagtgtgatccctggaaccagcagcacagacataacccataaccttgttagagatgcatgttctgccccactccagacctagtgaatcagaatctatgggggtggagcccagccatctaaacaggccgtggggtgattctgaggcttgctgtagtttcagagccattgtctagaatttaggaggtgggaacagcaaagagaaaatggcgaggcagtggctcacatctgtaatcccagcactttgggaggccgaggccggtgcatcacttgaggtcagaagttcgagaccagcctggtagtgaaaccccatctctactaaaaatacaaaaattagccaggtgtggtggcacgcacctgtactcccagctactcgggaggctaaggcaggagaattgcttgaacccaggaggcagaggttgcagtgagccaagatcgtgccactgcactccagcctgggtaacagagcaagattccttctcaaaaagaaagaaagaaagaaagaaagaaaatagcaaggcctatgccatggctcacgcctgtaatcccagcactttgggaggccaaggtgaagatcactggaggctgagagtttgataccatcctgggcaacatagaaagaacccatctctatcttttaaaaaaaatttttaaagagagaaaatggtcagccagaagcatgcaggcttcctgaggctgtcttttacaagcagctagacaggctgagtcctgcaaagggaagcctgcccgggtcagagcagctacaggcatctcaggctgttacagaggagccacgtacccttccagatatagatcttgccacagagcccgttgtccagcacaaagcagtcatcagatatcagcagttcaagggcaaatgggctggagtcagccaccttggtcaggttcatctgtccagtggcatcagagacctggggaggagggacagtgcctgatctcaccccccacacaccagccctcacctcagcctgaggagggggaggctggtcctccctaggtccctcccactgtgcctcgctgcccactgcccaggtcccaggagcagacaagagagtgaagacctgaaaagcaaattccaggcagccccactccctctcatcaccccaatccctgcagcacaggggccccgaacccatttggaaattaggtggattccaaattacaaagaaatgcacagaattcaagaaagaaaagctcagcattggcttcaagccttcaccaagcataggctggaagtgaggtgcactcatctcctcaggagggcctgccttccgcccactccccatccttgtctcactcccagccctgtataactccccacctcccacctcggttccagccccaccttccccctgccttctcccctccaccctgcttgcatgcagctgtgctgtgcaggctcccaccctccctgctgccgggtcccagggcaggcttggggggcccaccttatacagagctgcggcctgggcatttgccttgtcagctgtgaggtcttcctcagggttgccctccttcagagcaggcttggggcccaggacctgcaggggccagggcaggccaggtttatagggacccctgccctggaacttcccagcccatcatgcccagggccactgcttctggtggggcaaactgcgccctgcactagggcacccagcagaggtgaggtgagtgagggctgagtccagcccaccccaccagccaggctgctcagcctcgaggacgagcatctacccagaggggcaccctgtgagctggccacagccctaggcagtacaccagatggcccctgccaccctccaccggccactctcagccctcagctcatcaccacctctcttggccactttcaagcagaggctcccagccacccactccaatgtcccccaacctggatcatctcagcaggctcctccccatcagtgacaatctccacctgggccttgccctgtcgctcactgtcccggatggccagggccaggtccctcgccttgttgcgttccaggatgttggactttccaccacaccaggcgaagatgttctgcaaggaagcaggaaagtccgggtcagagccagatgcctgtgtcctgctccccagctcagagaagggcgcacagctctccctctctcctctctgaactgtccctgaggcaggacaaccaggaaggcagagcacagcacagagggctctctgaaaatgcccacgaccacccactgcaactgtttctctgcccacctgccatctgtcttcctttctttttttcgagacagggtctcactctgtcatccaggctggagtgcaaagacgtgatcatggctcactgcagccttgacgtcatgggctcaagcaatcgttgcaccttagcttctaagcagctgagactataagcacttgccaccatgcctggctaatttcttaattttttgtagaaatggggtcccactatgttgcccaggctggttacaaaccgctgggctcaagcctctttctttttcttttttttttttttttttgagatggagtttcgctcttgttgcccaggctggagtgcaatggtacaatctcagctcaccgcaacctccacctcctgggttcaagagatcctcctgcatcagcctgccgagtagctgggattacaggcatgtgccaccaggcccggctaattttatatttttagtagagatggggtttctccatgttggtcaggctggtctcgaactcccgacctcaggtgatctgcccacctcggcctcccaaagtgctgggattacaggcgtgagcagccacgcccagcacctctttatttttcttcccatcacatatctcctatgtttaaacgtctcttaaccacctatctccacctactagaaagtgagcttcattaggacatgaaggttttgtttggctttgctcaccactgtgggcccactgctaaaacagagcccggcatggatttaggcgcaaaataaatattgactgactgagtgaaggactggatgggtgaatggctgaatggctccttgagcgcagcatctcacacttctacccaccgccctgccaggcagagcccctgtcacctctccttttctggtaatggcgaggtctgttcacctgtccccttccttgtctcagcacgtgtagtcctcaccaagagctcctggattgatctccctgccccaaatcttcagcgccacaagacgcagcccatactcctcagccagccaatctcctcatgacctagggctcaccttccaccttgcttaggaatttccctccccctgctcctgtcccccagcccgggtcccagtctcactagacccctggtgtgtgcatgtctgcacccttccccaccttggtggctcagctcaccttctccctttgcctggagtggcatctcccctcctataggtctagtccaatgtcaccttcctgggacaactggcttcggctcaggctagagggcccctccctgccccaagacccccccagcacatggcagctgtcccccttaaagccctcatcacatcctgcctcaggttatggcaagtgactggcccatcttggctgcctccccagagcgagcttttatggtccctgtgctggctcagagagagcatcatagattcactgaacgaagagataaatgactgaattaatgaatggtctggcaggcagtgaactcagaggcttccaagaggagggaaaaagctccagagcatcagaggcaatgtctagatggcagaaggaggctggcatcagtccttacaaatatagggacattctccaatggtcagagtgatctcacttggaatgggtttacggcttctcagcttctctccctctttcctggcctcctgcccctccgtccttataaaggatggtgccaatacggagtgctcagtctggccagcctacccacctggcccaggtccaggatgaagcagtccccagtgttgaagctgtcccagttcagtgcccgctcggtggcacggatgttcttcttccccttcacctggtagagtttcttgatggcagctggggctcctgtggaggtcttgtgaaatgctgactccacaccaccttcctgcagcccagacggcccatctgagtggactgacaggagacccagagccctctgcaccccatcccactggaagacgggcagaaaggtggggacccggctccaaaggcacccgggtcttctgcagggtgagaaccagccagaagcagggctggctctgagggaagctgcagggtgggggtgcctagaggtgggctctgacctggtacttgaggccccgtgggaagtagctcatgaagaggtcagactcattgccctgcacctcgcggtgctgcacaggccgctctcccagcagcgtgttgaggtgcacagccagcacggcacaggccccctgctcatcccgggatgactgctggcctgggacaagtgggagagggcagggcaaggcccttgtgatccataccagccccctccctccccttcctgggcccaaccttcccccatccagatccccttacctatccacaggtgcagatgggaaacctcttctgggccattgtgcagcactaggtaggagtcccccgagaagaagacgccctggttctcttgcgccacaggcaccggcttcagcttctccacccgccacacatgcaggcctggatcctgcactgagcctgggaatggagagccactgcgagaagagagagggttgacagcagcctggacccacttgcccaagcacagccctgggcaggcctggcgactgcagtctggggatgaggagagcagtggggaggggcagcccttggaggtaaagaaggggaagttgtgaaaggagatggggcatgcagcttacctctggggaatggctgtgtacatgctgtcttcagatctggaaagaaagaagaagccattattattacaaatgccacaaaaaggacctctcacgtggggctggagaggccctttccagtggccaagtactttcatattcatcaactactccacctctaggagccctagttccattatgcagacaaagaaaatgagtctcagaaatgagtccaaggccacacagctagtgagtggttcatggaaataaggtctctgacccctgggccagggtcttccgtctgctgagatctcacagaaattaaaataaaagcagaaattaacagaaaacagaaacaagagagaagagcaatgaattttttttttgagactgagtctcactctgttgcccaggctggagtgcagtggtgcgatctcgcctcactgcaacctccgcctcccgggttcaagtaatcctccggtctcagccacccaagcagctgggattacaggcaacaccatcacacctggctaatttttgtatttttagtagagatggggttttgccatgttgcccaggctggtgttgaactcctaacctcaagtgatttgcccatctcagcctcccaaagtgccgagagtataggcatgagccaccatgcctggcctcaagttggcttttttttttttggagacagagtctcactctgtcactcaggctggagtgcagtggcgtgatctcagctcactgcgacctctgcctcatgagttcaagtgattcttgtgcctcagcttcccaagtagctgggattacaggcccacaccaccacgcctggctaatttttgtatttttagtagagacagggtttcaccatgttggccaggctggtcttaaactcctgacctcaggtgattcacgcgcctcagcctcccaaagtgttggtattacaggcgtgagccaccgtgcctggcaagttgtttttttaaaccgataaaattgataaatctttagacaaactgattaacagaaagagaaaacacaaatatcaatacagaaatgagagatgtgagatcaccatagattttacagatattaaaaggataaagggaatattataaaaactttatgccaatatattcaaccacttatataaaatgggcaaattccttcaaagacacaaattatgaaagctcattcaagaagacacagattatctgaacagtggccatatctattaaagaaaataaatttgtagtaaaaaactcgttcccccgccaaaaaacccaagcccagatggcttccctggtaatttctaccaaaaatttaaaaaggacataataccaattgtacacaaaatcttcaaaaaaagagatgacagaacacttctcaattcatcctatgctgccaacattctcctgataacaaaaccagataaatatattatgcaaaaagaaaattacagatcagtatctctcatgaacatacacatacaaaaattaacacaatttggctggacacggtggctcacgcctgtaatcccagcactttgggaggccaaggtgggtggatcatgaggtcaggagttcgagaccagcctggccaacatggtgaaaccctatctctactaaaaatacaaaaatttgctgggtgtggtggcacgtgcctatagtcccagctactcaggaggctgaggcgggaaaattgcttgaacccaagaggcagaggctgcagtgagctaagcccatgccattgtactccagcctgggtgacagagtgagactccatctcaaaaaaaaaaaaaaaaaaaaaaaattaacaaaattttagcaaatgaaatcaaataatatataaaaaataaaccatgatgaccaaatgaggtttatcccaggaatgcaaggttggtttaatatctgaaaatcagggtgatgatagctaataataatgcagtgtatatttcaagatagccagaagagaggatttgaatgttatcatcacaaagaaatgataaatgtttaaagtgatggatatgctaattaccttgatttgatcattatacaatatatacacatacattgcatatgtacaatgaaacatcacactgctcctgctaagtatgtgcaattattatctgtcaattataaatttaaaataaataaataaagccgctcacaacgcaaaaaaaaaaaaaacaggccaaaatttgaaaatcaatgctatacaccctattaacaaacatgtatgtgtaatcacctcaatagatgcagaaacagcatttagcaaaattctacattcattcctagtttaaaattttttcaagcctgggcaatataaggagaccacaaccctacaaaaattttaaaaatcagccaaggccaggtgcagtggctcacacctgtaattccagcactttgggaggccgaggtgggtggatcacgaggtcaggagttcgagaccagcctggccaacatggtgaaaccctgtctctactaaaatacaaaaattagctgggcatggtggcatgcgtctgtaatcccagctacttgggaggctgaggcaggagaattgcttgaacccaggaggcagaggttgcagtgagctgagattgtgccactgcactccagcctgggtgacagagcaagactctgtctcaaaaaaataaaataaaataaaataaataaaaatcagccaaatgtggtagtgcaagcctgtaattccagatcccagctactcaggaggctgaggagtgagtatcgcttgagcccaggagatagaggctgcagtaagccaagatcatgccactgaactgcaacctggatgacagagtaaaaccccctctcaaaaaaaaaaaaaaaattttttttttacccacaaactaggaatagaaagaaatttccttaacctgttaaaaaggcatctattaaaatacaacaaacaaacaaaaacccttcacctaacattatatttaatggctgctctaattctaaactccctccctgagaaatttcacccactcccaggcatcagctatcaattctgtatgcccagcttccctcaaatgccagaatgatgaacactttttctggacaaaagtcattcaagggaaaaaatgctaaacgcaagtattttttaaaaagatattatctttttaaaaaattcagaaaatgcaacagctacggctccactcactgtcgctttcataggttcccatcactagaggatttctttttttggctcaaaatgcagagatcacagagccagcatgcacttcgtacataatacaattcatgctgtgcatccatttggacagagtttgtgtaagatgagccccagtggcacagggtaagggcttggggaattggagggtaaaaatgcaagctggcaccattaggagattcttgggggctggggcagcaggatcaggaagtgcaatatttcgcaggggccagggaagtcaggggtagggggaaggcagatgacagagcagaaggtattaagtctgagtaggaaacaaagagggacaggtcaagggcagtgataatggatgtgaaatgctgtgtgaattatgactttccttttcctttcccaacctacaaaatagtggaaggcatattttggcaccacgattccggaagaggacatgcagagagcagaggtttgcggagggaaactttaacgtttctccatcccacagaggatcacatgctgtgcccacatcccctgcaacaggcagcccagcctgtgactcaggcctgagctggtgaagtggctgccccaagctcaagccatcagggagcgctcaagaatgagacacggagtgcgccaattgtcacctttactatttttcattctgtgtttaactcaaaatcaggcagcctacatgccagagagccacatcagggtttggatgaaaggggtttggcaggccgggtgcggtggctcacgcctgtaatcctagcactttgggaggccgtggtgagcagttcacttgaggtcaggagttcgaaaccagcctggccaacatggtgaaaccccgtctctactaaaagcacaaaaattatccggaaatcacttgaacctgggaggcggaggttgcagtgagccaagatccatgccactgcactccagcctgggcaatggagtgagactcggtttcaaaaaaaaaaaaagaaaagaaaggagtttggctgctcattagaatgaccttgggaccttattaaaatgtcggtactgacaaagattctttgcttggccaaactttaactaggcttctgaaccaccccgtaggcccatctgtgtgcttgtaaaatccggttttagcaaaagaaccctgctaaggccatttacctagaaccccctacccttgatatctggtcgatctgataatcgtggatatctgattgggttcctcaacaccctgcccccgccgccccagtgatgtctgatcactctggcctgtattcagcaagaatcctgttaggggccgggcacagtggctcatgcctgtaatcccagcactttgggaggccaaggcgggcagatcacctgaggtcgggagttcgagaccagcctgaccaacatggagaaaccccatctctactaaaaatacaaaattagctgggcttcgtggctcatgcctgtaatcccagctattcgggaggctgaggcaggagaatcacttgaacccggaaggcagaggttgcagtgagctgagatcatgccattgcactccaacctgggcaacaagagcgaaactccgtctcaaaaaaaaaaaggaatcctgttagctcagtctagccagaatctctttacccttgatgtttcctcttagtaattttcttttttttttttttgagacagagtttcactctgctgcccaggctggagcgcagtggcacagtctcagctcattgcaacctctgcctcctgagttgaagcaattctcctgcctcagcctcctgtgtagtgggattagaggcgtgcaccaccacatctggctaattttttgtacttttagtagaggtgaggtttcaccatgtcagtcaggctggtcttgaactcctgacctccagtgattgcccaccttggcttcccaaagtgctaggattacaggcgtgaggcactgcgcctgggccatattttttttctttaacagtgcccaagcccctggtctggggattctgattccacaggtctggaatggggcttgatcacccatattttgaacatatgttcaaagtgatggtagtagtgccagtgaattctgtccagaacagtgtcaaatgctcacctgcacattagaatcatttgggggcttttgaaaaaccccagtgccagccaggcatggtggctcatgcctgtaatcccagcacactgggagactgaggtaggtggaatgcttgagcttaggagttcaagaccagcctgggcaacatggtgaaatcctgtctctacaaaatatacaaaaattagctgggcgtggtggcgcacacctgtcatcctagctacttgggaggctgcagcacaagaattgcttgaacctgggaggtggaggttgcagtaagccgagatcacaccactgcactccagcctgggtgacagagtgagactctgtctcaaaaaaaaaaaaaaaaaaaagtaatttacagaaaaataagaaagaaaaaccccagtgactagcttccatattggactcattaaaaccagactctctaggtggagcctggatgtcagtgtttgagaagctccagatgactctaatgcttggtcagggttgaaactcctgctgcctcattagatctctgtcccgagaccttttgttccagtctctcctggggaagggtccaccctgacctctggcctttcattctttcccctatcccagccctctgtccaagcccacagctccttgagcttcctcagtgtccatgttcacccttacatccattaaagccccctcatcctaggctgggcacagtggctcatgcctgtaatcccagaactttggaaggctgaggcgggtggatcacttgagattaggagttcaagaccagcctggccaacatggtgaaactccatctctgctaaaaatacaaaattagccaggcatggtggtgcgtgcctgtagtcccagctacttaggaggctgaggcaggagaattgctggaacccgggaggcagaggttgcagtgagccgagatggcactactgcactctagcctgggcaacagaggaagaatctgtcacacacacacacacacacacacacacacacacacacacacaagcccccttatccttccaggcccgtatcaagccccagctgtccaaggaaacttccaggacattaagtggcctccgccttctctgggagttctcccagccctctcccctgggagcacatactttagcctgttttatagcataaactggctgcttcacatctcaactggagcaaggacacacctgatgcctctgttcctcaagcagcccagcaaagagtctattccattccactcaacgtctgtgctgggggcttggcactgggggtgacatgcacagagacaaagaatagcccatgttttatggtttagctgcagggtgcagtgaacaagggagccaccatacccagtgaaaccgcagacgaacttcctctaagtggggaatgtcacagaatcacagatgtcagcattagaaagtgctaaagttgaagaggggagctggggccgggggggaggaataaaacaaaaaaaagaaagcgctaaagttcttatctagtcctgctctgcctgcaccgccctacacatacccatacacgcatagtgcagaaatctcttctatagcatcccttaccatcctcttcttgaaggcttccagtgatgggaaactcaccaccttaccaaacagcctcttctacacctcttaaagcctttacttttccccactctgccatagtgtggtgagttatggacccgcctacctccactactacactgtagggtcctttagggcaggaagtgtattttgcctctggatctagctggaacctcatgcaggtgctcaaagaatgcatttgattaactggacctgctgggctctgattattagactggggtggcacctaagggatagcccaggatttcaaaaggctgggacaggctggagcagccccaggaggcagagagcaggggctaggggtcccagactgccatggggctgggggaggggaggacgcaagtcctgctggctgtcccatggtcctgacttaggctgtctttgaggacacactgggggacctcggagaggaggtcaccgttacacacacctttaaggaaagacttgacagccatcagagggacaaaaatcctgccggggtccagtggtacctttgccttcctcagaccctgattccactgacccccaataggtctcttcccttcacagtccctgcttgcccctaggtgtgaaatgaaacagcacctccacttctcctggtggaggtaggtgcccaccctcgaaaccaaactgaatctcccagcctgggacatggcattctcagaatctaggtccagaggcctcatttggggattccaaatggtttttcccctgataccaaataggtctcctacccttccccagggtcaaccacttcctccctccccacctcctacctcagacagtccacctagaccctcagccaaggtcttccagagtttgcaaaataatcaaatgtgccacttgcatttgaattcaaatggctaggactgccctgccccctccccaagccactcccacccaaatagcatcacaccacagtcctgtcttggggacaggcagcttctaatctgatttcacctccagtctggctgagggccttcaggagcagtgtggtggcctccgtcaggaggtctggcacagctgggacaagccctgacccaagagttcctccatgtgcagcatgggcacagcccacccatcctcccgggcagcttcacagctgccatcagatcaggtgcctggagcctggcataaggctggcaggacagcaggctgggggaactccaccctggcacaatgtggtatccagaaatgtgggtctctgttcccaggccaccacagccagccctcgcctgcccacccaggagggtaccagccagccgcgctggcagccaccctgccaccttcacctttcaacactcctactttcctttcttcctcctacctctgcttcgtaggttcgtcttccttccagcctgccccacccggcttctcacttccctcttacttctctggctgccccaaccaccagccccacccaccagccccacccctgggctccttccccagccggtgtggaggcgatgtcccccgacagggaggggcaggcagtgctgggaggccagcaggcctgaagcagaagagcagtcactggggtgggcagtgggtatgccaggccgtc

SEQ ID NO: 1591 - DNA, 37033 bp, Homo sapiens
aaatgtagttctcggggccaggggagccggcacggaagcggctgtgcgcatgagcagatgaggcctagccgaggcggcgggacccccaagtttggaaagctcttttaacggtgagaacgcgttaacacttgccaaggggagtggttggtgcctgtgcggagctagcagccggcctgaggagggagggagaatgtgatccggtggaaattatcactatggggcgagacaaggccgagagttgtaagactgaaagagaatcccgactgggagacaggagtcctgagttctggtcctggctctgccctggactcgctgccttgaggtgttaaattgctttcctcgtcttacgcctccaggctatgcgaaagttctgtccaaaggctgctcacagcccctgtctgactggttgtcatgatgaattgagctctctgttacctgcgcatcacaaccggtgagcgtctgtctctgtgcccctcaaagtggcccatagttttgtcctgggggcccgcctgggacggagtcctctatggcgggtccctaatgacaccccatccgtggggaacctgggggacggggagccgcccatggacaagcatggtgaaaggatcagctaagggcccatctaatttaaattcctatgcagagaatctaacctccagcaagcagttgaagaatcataccccctccttgcctaaagagggtgcataatgaatacttgattggagaaggatccatttttacaggaaggccgtttccttaggtccaactatcaggaatttgcctttgagtacttccttgtttaatggaattgttgctcttttcttctctgctacagatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggccccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacccaaagttgtgaactatgattgtcagttgtgtgtgggccatctgcccacttaggatgcaatttttgatgtgacagacattccggatgtccaattcccctgtgatgaggtatgagccttgtccagcccttttcctgagggaagcaatgtcagatgaaagacttagaattgcccaaactggctagccagctgccacatgcacagtattgctgataactgagaaaggttagaacatcgtgttgcattttgaatttctaccattgttggaaccaggtctagtattataagcccctgacccagcctgtgtgtgaggcctaaacaaagcctgagcacttcagctaagaccacccaccaaggtgacacctttagcctcacgcctttgataagctggcccaggtcccagtaactccattgtcagaaacagaccccatcccttctagtggtgctgctgccttttggacacagaatccagctcacagtcccctgtgtggtccccttttggccatcctgtggcttgggtagtaagaggtaagcatttggctgaggcaagttgttcattcagaataaattcacagctgcttaaattttgtcaacaggccgagcgtgttggctcatgcctgtaatcccagcactttggaaggccgaggcaggcggatcacgaggtcaggagttcaagaccagcctaaccaacatagtgaaaccccatctctactaaaaatacaaaaattagcagggtgtggtggcgcacgcctgtaattccagctactcgggagactgggacaggagaatcgcttgaacccgggaggcggaggttgcagtgagccgagatcgcacggctgcactccagcctgggcaacagggcaagactccaactcaaaaaaaaaaaaaaattgtcaacagaggcataactgaatggtgaaaccagttttctttttcaatttcttttttttcttttgtgcagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacaggtaagcatgcactcttatttgggaaaggtggtgttggtttgagatatatcattaagtatagtaagaatatattaagagaatatttggaaaaatttagaaaccctcattatagttctctttgttctgtaagaaggagcttctattcacctcagggtcaattgcttttcctaatagcttgttttgtaagtgagttatgagatttttgttttctttttgcttgggtagtggggagaatttcattgaggaatcacccaagaaatctgtatttcattgatttggatcattaccttactagcctcttccctgtgaaacgcttgctttggcctgatcatcctcaggactcagttcaatgtgatatgtctttgtatgagccgggcagctaaccctacatgccttacctttcacactactttgcccacccaaaaatggtcttaaatggaggctgtgggattcagtggccagactgggacaaagcctttgctttgggtctccagaaagattttcttcactgtagtaatatgcgaactgttccaaagagggaagtctttggacactggaggggactgaattggagaaggaaaggaaggatgaaatgaatctcaggtacacagatgcctgcaggaagttgttcagcacaatgaatcaccaaatattttagagataaaatttcaacaaaaatttgagaaatatattttgtgcttagtactgtgccaatggttgtgaaacatataaaagaaatataagagcctggaggcagtggctcacgcctgtaatcccaacactttgggaggctgaggtgggcagatcacttgaggtcgggagttggagaccagcctggctaacatgatgaaaccctgtctttactaaaaatacaaaattatctgggcatggtggtgcatgcctgtaatcccagctactcaggaagctgaggcaagagaatcgcttgaacccaggaggcggaggttgcagtgagctgggatcacaccattgcactccagcctgggtgaccaagtgagactctgtctccaaaaaaaaaaaaaaaaaaaatgaaaaaagaaatataagagaaggtccttatgcaggccttttgcagaggaacttttgctgcatacaagggttactggacttagaggtgtgagacagcattgtagccccagctagtaaggtaggttgccttgagtaggtggaactgaccttgatcagagaagagagtggaggtgtattctggaggaaaactacatgaacaaagggatggaagtgaggagagggatctgcagcaggtgtgttgattgcattacagtgggaaataaatgcttagccatcatgagctcctttaccagggagcttggtcagctgtgaggtgttttggcctccatccttgcatctggaacatgaagaaatgaaagttgtgtttaatgagcattagttggaaaggcaaaaaaaaaaagcagaaggattagagtaacaggatgatctgggattccagggccttggcataatacattcacatggttcaaaatgcaaaaagtacagaacgatatatgtattgtgaagaaaccaccttccacccttgtccccccagccactcagtttttctgctggagacaaagctactgcttccttgggtataactgtgaaaatggtctctgcagagacaagcaaatgtgcttatgtacttttaaaaaataaaatggtaaaatagtgtatagactctgtcctttgctttttcacttaatacatcacggaaattgtcccatattgcctgtaaagtaaagcactttctcatttgtctttatggccatatagtatctcactgagtgaatgtgcttttatttatgtaaatcagcccattaatgaacatttaggtttttccagcctttccctattataaacagtatgacaaagaatcacactataaatgtaaacatgtcggttttgcacatggatgaatatatctgttagataaattactagaatgcagtatcaggccccgcatgtacaaaacatgtatgatttcattaggtactatcaagctgtagaggtggtaacagtttactctccagtgtgttatgcactctggccaatgtacatgttatcagactttttgatctttgataatctgactaatgaaacacagtagttttacatgactcttttttttttttttttttttgagatggagtcttgctctgttgcccaggctggagtgcaatgacgcgatctcggctcactgcaccctccgcctcccaggttcaaatgattctcctgcctcagcctttcgagtagctgggatcacaggtgtgcaccaccacgcccggtgtgctaaaaatacaaaaaaaatacttttttgtatttttagtagaaacagggtttcaccatgttggccaggctggtcttgaactccagacctcaggtgatccacccaccacagcctcccaaagtgctgagattacaggtgtgagccacggtgcctggtgacgtttttctgttttgcttttttttgttttgttttgttttaatgagtgaggttgaacatttgttcatatgtttaaaaccaatttgtgattgtgcaggatggctcgtgtctgtaatcccagcactttgggatgtcaaggtggcttgagcccaggaatttgagaccagcctgggcaaccatatgtagaccccatggctacatgggcatggtggtgtgcacctgtggtcccagctgcttggaatgctgaggtgggagaatcccttgagccaagaagtgagtgagccatgatcgtgccactatgccccaagtggggcaacagcgcgagactctatctcaaaaaaacccacatggagaaaccccgtctctactaaaaatactctactaaaaattagcagggcgtggtggcgcatgcctgtaatcccagctactcaggagtctgaggcaggagaatcacttgaacctgggaggcataggttgaggtgagccgagattgcaccattgcactccagcctgggcaacaagagcaaaactccatctcaaaaaaaaaaaaaaaaaaaagccaccatttcagttaccttttgtgtaaaccatctatatcctttttctaatgtttccactgggttggtttttcttttttttttttgagatggagtctcactctgttgcccaggctggagtgcggtggcgtaatctcagctcgctgcaacttccacctcccaggttgaagccattctcgtgcctcagccacctgagtagctgagattacaggcatgtgccactacatccggctaatttttgtactttttagtagacattgggtttcaccatgttggccaggctagtcttgaactcctgacctcaagagatcctcctgccttggtctcccaaagtgctgggattacaggcgtgggctaccacacccggctggtttttcttttttgccttaatgattttttttttctctgagattaaactttattaaagttacttttccagaaaattcagtgaatatggtaacataggaacaaacttaggctcataagccctttacatttttacataatctttaatgatgttgatcaggaaattctttcactggtagaattacttctccattctccagaattgtatcatctgggaatattctgggcttcttttcaatggtgccatatggtttttttagatacatgatacttcttggtgctctatatgttcagagaaacttctctagtaacaaactatagaaatgatgattttttattttttaaacagtagagacagggtctccgcatgttgcccaggctgctctcgaactcctgggctcaagcaatcctcctgcctcagcttcccaaagtgctgggattgtagctgtgagccaccacacctggtgatttttaggattttaaaagaacacgttgaaaaattagctctgtatctgtgaaatgagttacaaacaattggccgagtattttggtcggttttttgtttttcatctgtagcaggggataggtttggctgagcagaaaggccataggaaactgcttcactaaacttcgctcactcagaaccctcagactttcaaagagccaggaaatcggtataaaatttttgagataacattaattaagctttttgcagtttttcctaggaccagattaaacagaagttttcctttacagtattcattatggttggtatctccagagttcatcctttttttgtggtactgggaaaagttgcaacatttacctttgcagggacatggatggagctggaggccattatctttagcaaactaacacagagcagaaatccaaataccacatatcctcacttataagtgggagctaagtgatgagaacacatggacacatagaagggaacaacacacactggggcctattggaaagtggagggttggccgggcccggtggctcacgcctgtaatctcagcactttgggaggccgaggcgggtggatcatgaggtcaggagatcgagaccatcctggctaacacggtgaaaccccgtctctactaaaaatacaaaaaaaattagtcgggcctggtggcaggcgcctgtagtcccagctactcggaaggctgaggcaggagaatggcgtgaacctgggaggtggagcttgcagtgagccgagatcgtgccactgtactccagcctgggtgacagagtgagactccgtctcaaaaaaaaaaaagaaaaagtggagggtgggaggagggagaggatcaggaaaaataactagtgggtactaggtcaaatacctggctgatgaaataacatgtacaacaaacccctgtgacccaagtttccctatgtaacaaacctgcacatgtacccctgaacttaaaagttaaaaaaaaaaaaagtatgacatttaaactattatctttgggggattaatatgtgcctaggagattgacccttgtctgttttacagggtgaaagattgtctgctggatattctccatcatatgacaaggacaagagtgttctggctttcagaggaatccctgtatgtatcacccacaacttggtaccttctgccagggcttttgttgtgtgttactgtgtggtgccagaactgtggtagacgctggggacacaagggtggcatagaccttagcttccaagagctcacacttgaggggagtgaggggagggtgtatggaacacaaacatacaaaacaacttctatttaataagataattgccataatgaagcaggctataaaacgcagagagaataccaaaggcacaccacagtctgaaatgagtgtatgaatttttgtttatttacattcaaggtggacatacacttgtccccaacatcacccaagttccacatcatagttaaagttttccaggtacctcaatttaaaatggacttcaaggccagtaagtggctcatgcctgtaatcccagcactttgggaggctgaggcaggcggatcacttgaggtcaggagttcaagaccagcctggccaacacagtgaaactccatctgtactaaaaatacaaaactagctgggtgtggtgatgcacacctgtagtctcagctacttgggaggctgaagtaggaggatcacttgagcccaggaggtggaggttgcagtgagccaagatcaggccactgcactcccgcctgggcaacagagtgagactccgtctcaaaaaataaataaataaaaagtaaaagaaaataaaactgacttcagtcaacccatcagggcacactaggtccttttggcctccagtgtcaaggacattcagtacagtgggtgggaagcgtttgtgtatatgggggtatgtggattctatcctcaagctaaaggtcagctgcctctacagatctcagagttgaagaaccatggcattctccaggctctgaccacagaagcttatgaatgggagccacgtggtaaggttcccttcagggcccttggagtctgggtgggacccaagtcagaccttcccatgcatctgctgttcatcatttgaatttctctcactccttgtctttcagaattttgtagatgtatcagtccttggggaaaaatagaatcaacactgaattaggaatcaaaagaccagagttctgatcttcctctgctagtggtttactgtgtgcctctgggcaagccatatgatctctaatattagtacctcccttatcctcaaagggatgttatgaaaatgagacacaatataggaaaagcctttgaaaagttattctacttcatctgctttgcaaggcgcttccccatactatatttaaagttcactctacttgccaagtgattatggagaaaggtacactccagcctggccaacatggtgaaaccccattgtattagtccgttttcatgctgttgataaaggcatacccaagactgggaagaaaaagaggtttaatggacttacatttccacatacctgggtaggcctcacaaacatggtggaaggcaaggaggagcaagtcacatctcacatggatggtggcaggcaaagagagagcttgtgcagggaaactcctgtttttaaaaccatcagatcttgtgagacttattcactattatgagaacagcacagcagagactggcccccatgattcaattatgtcccactaggtccctcccacagcacatgggaattatgggacttacaagatgagatttaggcggggacacagagccaaaccacatcaccgtctctactaaaaatattttaaaaattagccaggtgtagtggtgtgtgcctgtaattccagctactctggaggctgaggcacaagaattgcatgaacccaggaggtggaggttgcagtgaaccgagattgtgctactgcacccatacctggccactagaaatatgaacttttaaaaaaatactcttttttttttttttttgttagggacagggccttgctttgtcccccaggctggagtgcagtggtgcaatcatagaatttgtgggttcaagcagtcttcccacctcagcctcctgagtaattgtgtaccaccaggcatagctaatttttttttttaagagacaggttcaccgggcacagtggctcacgcctgtaaccccagcactttgggaggctgaagcaggcaaatcacgaggtcaggagttcaagaccagcctgaccaacatagttaaaccccgtctctagtaaaaatacaaaaattagctgggcatggtggtgcacgcctgtaatcccagctactcagcaggctgaggcaggtgaatcacttgaacctgggaggcagaggttgcagtgagccgagatcatgccactgtactgcaccctggcagcaaagcaagactccatctcaaaaaaaaaaaaaagagacaggttcttgctgtgttgctcaggctgatcctcaccttatcctcctgagtatctgggaatataagtgtgagcttctatgtgtagctaaaaaatattctaatataggaacatcatttggacatctgtgaagtttcttttaatggaattttatctttatggtgacaaacccagcattaatacattaataatttttactttaaatacatatatatatatatatatatatttttttttttttttttttttttctttccagagacagggtctcactctgttgtccaggctgaagtgtagtaatgtgattgtagctcactccagccttgaactcctgggctccagctgggactacaggtgtgcactaccatgcctagctaatttttaaaaaatttgagatggagacggtctcattatgttgcccaggctggtctcaaactcctggctcaaatgatcctcccactttggcctctcaaagtgctgggattacaggcatggtggcatgtgcctatatctctggctaactttaaaaaaaaaaaaaagtaaaaaataaatgtaggctgggcacggtggcccacgcctgtaatcccagcactttgggaaactgaggcgggcggatcacaaggtcaggagttctctaccaaaaatacaaaaattagccaggagaatcacttgaacccgggaggcagaggttgtagtgaaccgagatcgcaccactgcactccagcctgggcgacagagcgagacttcttctcaaaaaaaaatatatatataataaataaaaataaatgtaaaagagaattaataaataagctgactcaattggcagtgctcttgactatatgagtaagtggaagagagctgaaataaaggagacaattataaaaaggaaaaaagataacctaattaacgtgagctgtgttaattatcctgactatttgtcctttgcccccgtgttcttctgttggtcaggggaaaacagtatttatgtcacacgtaggaggcatctccctcattccaagagaaaaggagaagctcttacgtggtttgggcatttgtgttgaggttttaagcaccagcttgctattgctggtggaaaccttgaacttttgttgactaacctgttttgacagcatattcccacccccttgccactgtggttcctgctcctggctcacagactttgatcaagctgtttgtaggcgagggtgtatggggttggggagggattggttaagttgctggtagatgaggctctgacaggtgaagaatcaataaatcaataaagctgcatgaaggtaagagggtgaaggatcctgttcagcttcataataagcattgcatcctgctgttctactcttcccccagtccctttttttttgaaacagagtctcactcttggcgcccaggctagagtgcaatggcgcaatcttggttcactgcaacctccgcctcccgagttcaagtgattctcctgcctcagcctcccaagtagctgggattacaggcatctgccacatacccagctaattttttttttttttttttgtatttttagtagagacagggtttcaccatgttggccaggctggtctcaaactcctgacctcaggtgatccacccacctcagcgtcccatagtgctgagattataggcgtgagccaccgcacccggcctactcttccctttttgttcagccactttgtccctcctttttagctcctatgctgaaagtaagttttattttcttgatcctccaaggttgaatattctcttaaagctgtcttaggaactccaaggctcagtgtctgctactccggactggagcaggtgagatggaatttcctaaaggtccagatatttaggaccctggacccatctcacccgctgcctctgtccattgccctgctggacctgagcccacacctatgttgataataatagcttacatttgggccacgtgctctcctaggaagtagaattaccccatcctcacaacagccccatgaggggttacagatgataagtaacttgcctgaagacatacagctagtaagaggcagagatgaagcattcacaagtagtttggctctcaagtgtgctttcagtaactatcctctactgcttcccagccgctttctcttccttattatccattagtgtctggtagcatttcatttaatctgcaggtatattctcccaacagtttattgtcatgtgatgtcctcagccaagattgtgaggcagagaggagctgtcccaacctactataccaccgaggctggagagatcatatttttggtattaaactggagtctctccatccttcacattgttgatgtcctctgtagcaaaccggaaaagtcagtgacagaagatgccgctagcagtttgagccagagaatgacagctctggtttggagaaaagggccggatggtggctctagaaagcccatccttctgctcttctttttttctcccccttatattgtgctttcattcattcattcattcatcaaacatttgttgagcacctattatgtgtcaagctctgtgctagcctctggaaaacctgccctcatgtagctcactgtggagtaggagaaacaatgactacactatgataagcacgggttgtcagggtctcacagagcagtggcccctcatccagaccgatgaggtcaaagaaggcatccaggcgaggatggtgtcagagctaactgaagaatgagagggagctgcaccagcaggggttggaactgaaggtggcagtgcctggagtcttgattccagcagagggagagcagtctgtgaaaaggcaccaagggtgggagagggcagagcacatggaggaacttcaggtagttctggatggccctggggcaaagctagagaggtaagaagaatctacaaatgttcctcgagttacatgaacttccatcccaataaacccattggaaacgaaaaatttaagtcagaagtgcatttaaggctggtccgagtagaatgatttttacaacgaattgatcacaaccagttacagatgtctttgttccttctccactcccactgcttcacctgactagcctttaaaaaaacaaaaaatttaaaaacaaaaagaaaagaaaaatgcatttaataccctgataaatccatcaaaaagtcaaacaattgttaagtggaactgtcatgagttggggaaccatctgtagattgtgaagttatgtggatactgtgctgtagagtatgggttttatcttgaggactgtggagaatccctggagggttttgagcagtgatgtcggatcttacttttcttttcttttttttttttttgaggtggagtctcgctctgttgcccaggctggagtgcagtgacatgatctctgctcactgcaactccgcctcccgcgttcacgcattctcctgcctcaacctccagagtagctgggactacaggcgcctgccaccacgcccagctaattttttgtatttttagtagagacggggtttcactgtgttagccaggatggtctcgatctcctgatctcgtgatccgcctgccttggcctcccaaagtgctgggattacaagcatgagccactgcgcccggccaatcttacttttcaaaagctcactctagcaaacctgtgaggagaggatcagagggtgttaagatccaaggcagccagatgtggtagtgcgtgcctgtagttccaggtactcaggaggctgaggcaggaggattgcttgagtccaggaattctgggctgtagtgtgccatgctgatcatgtggccccactaagttcagcatcaatatggggaccacccgggagtgggggatcaccaggtggcctaaggaagggaaaactggcccaggtcagaaatggagcagttcaaaaatcctgtgctgatcaatagtgggatcatgcctgtgaatagccactgcactccagcctgggcaacacagtgacaccccatctcttaaaaaaaaaaataggcccaaggcaggcagacaaggctggggtctgcagtagaggcccagacatacctagatctcagagggtctccttttctcctactattgcagttgtgagtacagaggtggtcagagcccaagaagaatgggaagctgtggacaccatccagccagagacaggtaactgtacgaatgctgctgtctccccatagcccctctgccagcaaaggcaccatccacacatgtggcaaatgtttctgtgagtctgggactaggagatagaattcctgagagtgctcattttaactatataacatagattacagtacctttttcaaatcctaagatgatgacatcctacctctggaggaaaccagagtgaaggccatggagaaagggctgccatccctgtccatctttcacccagccatgagagaagacagggttgaccttggttagggcagcttctacagagtggcaaggctgggtaggaggatggagatgggcccctgtgtaaggctgctcaggttgtttactgcacaaggaagtccctggggatgggagctgaagcaatctgctggaaggctctgaaggctgagtaaaaattgtctcctgtttctttctaagaggttggatgaagagatagaactaggacctatatctagcctgagcctctcttcagctccttgggcccagtgaatagtatcagccattgcctatattgctaactaatcagttaattccctattggctataacagaggtgtatggttgggggttcctatacagggtgtaagaagggaaaagtggaaattaggaaaggcccttaaacaaactggttgcatgctcttatgtgggtacccaccccaggcagtgacttgccccctcgtagatgagagcatttagggatcacctcgtggggcagatccgccccatacccaccacagaggctgacctagcaagactgaatagcctcgtccaaaaagagagtcctcttcgccgacaatgccagcctcttgaaagaagattggttgtagctgtaagtgtctgatgttcaactggaagccagtgcttggcttggaagtgacaagtaggagggcctcagtaaatgtttgttgacagaatgactcctataaatcctggcatgtcttccgttttgccacagggagccaagctagctcagagcagcctgggcagctaatctccttcagtgaggccctgcagcacttccagactgtggacctttcccccttcaaggtatgagggtagcagggtttggagtctcaagcaaagtgccttttccctaggagccaagcctctatcccaccaggacagggcattgggcaagcaaatctcccctaagatcttggtgcccaggatcatgggtggcctaggacccatgcttcatttggggccttggtagcttttgtgggactatgcccttacagctcctgtagccctgtcattcaggggcctgtatagctgtttatctactcttcccttttagggatggggacatctagagtcaagtactaggtagatccttgcagaggcaaggcaaactgttcagggagctgagtgattcatggccagtggaggaaaaccttccattccctcaaggaaccagaagctatttaggaatttaagaaagatataagctggaaaaagaaggaatatttgggggaataaacgctaggggtggggtgggtgctgggcatagtggctcacacatgtaataccagctctttcggaggaggctgaggtgaggggtcacttgaacccaggagttcaaggctgcagtaagctatgatcacacctgggcaacagagtgaaaccctgtctccgtaaaaaaaaaaaaaaagctggggagctttctgggccatattgagtaacaatacgtttagagaaatgtgatttcaggtcttctacctaaaaccttgctcaggggagagaggctaaaaagataggaaccaagttgttttataggacccagagagccgaaagctaccgaaatcagaatattctaaggcttgcagtagtgaccctgagccatgagaagccaacatgacctcacttgggaagtgctggttgtgaccaaaagattccagctacccctcagagtcatctaactctagtgggtccccacctcctgggaaacctgtcctggcatttgtctgactgcctgggggagctgggcaggtgtaacccctgtgggagtcagtggaatacctagttctggaaaagcccagaggactaaatgcaaataatggctgataatacctacgcttggggatgtctttcaccttgcaaaaaatctgggagctggaagagcctggctctagagactcaacaggtgccttgcagcttctgcctccttcccttggcccaaaggccagccagatagctgggggagttactttctgcaagcactgcctctggtctgagcctgatgggaagttgattaagggaaatgaaccagcattctgcccattgcctgcaacttcttccccagaaaagaatccagccaactattcgaaggactgggctcgccgccctccgacactacctcttcgggcctccaaagctccaccagcgccttcgggaagaaagggacttggtcctgaccattgctcagtgtgagtgcaatgcgagcccacagggcagttgctgcatctgtggttgggcaagaccgtgtgtgctgaccctgtgaggctaagccaggaatattgcatgtaccatggttggcgggtgagagtgggagctgagaactggatgtctcacagtccagatctcacattctctgagaagcacccggttctcccatgaggggcaatctggcagagagtgtgggtgtgttttggggcaggtggcctggatagccaagacccagtgcatggccgagtcctccagaccatctataagaagctgaccggctccaagtttgactgtgcccttcatggaaaccactgggaggacctgggctttcagggtaagagggaggagtagctcatcttctttttcatgcctctgattccaggactagagtgagaggccaggtcgttctcttccagtgctatgagggggaagatcttgggggagtattccgggaagagggtgcagcaaatgcaaaagccctgagggggcgcctgctagttctgcttgaaaaatagcaagagtaggtcgggcgtggtggctcacgcctgtaatcccagcactttgggaggctgaagagggcagattacttgaggtcctgagttcgagaccagcctggccaacatgatgaaatcccatctctactaaaaatacaaatattagggtggggtgcggtggcctgtgcctgtaatcccagcactttgggaggctgaggtaggtggatcacgaggtcaagagttcgagaccaggctggccaacatggtgtaagcccgtctctactaaaaatagaaaatttagccaggcctggtggtatgcgcctgtaatcccagctactcgggaggctgaggcaggagaattgcttgaacctgggaggtggaggttgcagtgagccgagattgcgccacggcactcaagccttggtgacagagtaagactctgtctcggaaaaaaaattaaaaataaaaattagccaggcgtggtggcacgtgcctgtaatctcagctactcaggaggctgaggcaggaaaatcacttgaacccggaggcagaggttgcggtgaacagagatcgcactactgcactccagcctaggtgacaaagggagactgtctcagaaaaaaatagccagagtgtggctgaggtggagatgaaagtgacaggaggaaagatcacttggtggtcttttaggctgttgtaaacatttactgtaagtgatatggaaaacactggagtgatgtgacagaatctggcatttttgggttttttcctctctaaaaaatatttatgaaaattttatcatatattattttactttctgagtgaaacagaatcatttcaccagtttttggattgtactattttttttcaaaaccatatcaaattggctgggcatggtggctcacacctataatcccagcactttgggaggccaaggcaagtggatcacctgaggtcagcagttcaagaccagcctggccaacatggcaaaaccccaattctactaaaaatacaaaaattagtcgggtgtggtggcacgtgcctgtagtcccagctactcgggaggctgaggcaggacaatcgcttgaaaccgggaggatgaggttgcagtgagccaggattgcgccactgcactccagcctgggtgacagagcgagactctatctcaaaaaaaaaaaaaaaaaaaagacaaaaccatatcaaattatatttgtatagaataggaaaataactttgaaaggaaactttaaggccgggtgctatggctcactcctgtaatcccagcacattgggaggccgaggcaggcagatgacttgaggtcaacagtctgagaccagcctggccaacatggcgaaaccccatctctactaaaaatatataaattagccaggcatgggggtgtgcacctgtaatcccagctactcaggaggctgaggcaggagaatcgcttgaacccaggaggcggaggatgaacccaagattgcaccactgcactccagcctgagtgacacaacaagactctgtctcaaaaaattttaaaaaaaagataaaaggaaactttatgtacccctaattaactggtggtctgttggtatggcaacatggttaagtccctgttccctctctcatctatcatgtaattgtcttaaatgtatcctctctatatattgagaatcgcaccagtaatgttaagatttttgtttcaatcaacaaacataatttttttgaggaggggttctcacgaagaaccagaaaacctgctagacaaattgtagaagagctgtgacactgcaatatacataatttctgaatctctggagaaaaaggaaaatctgggccaggcacggtggctcacacctgtaatcccagcaccttgggaggccacggcgggaggatcacgaggtcaggagttcaagaccagcctggccaaaatagtgaaaccctgtctgtactaaaaatacaaaaattagccaggcatggtggcgcgtgcctgtagtcccagctacgtgggaggctgaggcaggagaattgcttgaacccaggacgtggaggttgcagtgagccgagatctcaccactgcgctccagcttgggcaacagagtaagacttcgtctcagaaaaaaaaaaaaaagataagaaaaaggaaaatctattgtatttactctttccattgtttgttcttccttcctaaccctctttttttttttttttttttctatttcaaggacttcctttagttattctcttaggataggtctgctggctataaattgtctttgttttccttcatctgagaatgtctcaatttccccttcacttctgaattctctggatataaaattccaggttgacagttcttttttttcagcacttgaaaatgtgctacttccttctggcctgcatagtttctgatgagaaatccactgtcatttgaatgatctctcccttataagtaaggagttcatattctctttctgctttcaaaatattttttgtgccaggcatggtggctcacacctgtaatcccagcactttgggaggccaaggcaggaggactgcttgagacaaggagttcaagatcagcctgggcaacattatgagaacctatctctacaaaaaataattttttttttcttgagatggagtctcactctattgcccaggctggagtgcagtggcatgatctcagctcgctgcaacctccacctcctgggttcaagcaattctcctgcctcagccttctaagtagctgggactacaggcctgtgccaccacacccagctattttttgtatttttagcagagatggggttttaccatgttggtcaggctggtcttgaactcctgacctcaaatgatccacctgcatgagcctcccaaagtgctgggattacaggcataagccaccatgcctggccaaaaaaaaaaacttttgtttagtagccaggtgtggtggcgcatgcttatagtcccagctactggggaggctgaggcagaaggactgcttgagcccaagaagtcgaagctgcagtgagctgtgatagcaccgttacacgctagcctgggtgacaaagtgagactctgtctcaaaagaaagatctttgctggccgggcgcggtggctcatcctgtaatcccagcattttgggaggccaaggcgggtggactacgaggtcaggagttcgagtctagcctggccaatatggtgaaaccccatctctactaaaaaaatacaaaaattagccaggcatggtggcatgtgcctatagtcacagctgcttggtgtggaggcagaggttgcagtgagccaagatcgtgccactgcactccagcctgggcgacagagcgagattccatctcaaaaaaaaaaaaaatctttgctttgtctttggttttcaggaatttgactgtgatgtgtcattgtgtggatttatttgggcctctcctgtttgaggttagctcagtgtcttgagtctgtaggtttgtgtcttttgccacatttggtcaattttcagctgtgattcctttgaatactttcttcagctccacactttgtcctctcttgtgggattccaatgatacaaatgctatctttgttcattttttaaaatctttgttatagcctcagatctccaaggctctgttcattttggtttttgtttttctgtccctctgttgttcatattatgttattctattattactgtcccatattcaagttcactgattctgttgtctccgttctcctgttgaccccatccagagagtttttagttctagttcttctatttttcagttctaaagtttccatttggttcttctttatatctgctgtttctttactgaaactttctattttttcattttttcaaagtgtatttgttcataattgcttaccaaaggcattttatggtagatcctatagtcactttctatcattgctgtaacaaattaccacaaacctagtggcttaaaacaacacaaattattgtcttatagttttctagttcagaagtctgactcaggtcttactgagaacctgtggtcaagatcaaggtgttggcagcacagtgttctttttggaggctctggaagagagtccatttccttgccttttgcagcttctagaggccacctccattcttccatcttcaaagccagaaacagcatctctctgagcccgattcctcacatctctttctctggctctgggcttccgcctttcttttccacttttaaggacccttctgatgacattgggcccacccagacagtccaggatcatctccctctctgctgatcagcaaccttaattctacctgcagtcttaatcccctttgccatgttacataacatagtcatagcttctggggacatggtcatcgtggggcggggggattattttgcctaccacggctgctttaaattccttgtcaaataattccaacaactgtgtcatctctgttggtgtctgttgatcatcttttctcattcgaattgagaattacctagttcttggtgtaacaactgattttttattgtatcttagacattttgggtagtctgtatgagactctggatcttacttaaatcttctactttagcaggcctcccctgttactgtgccagcaggggaaggagggacgtcaccatgttactgccaggtgggggtggaagtccgggtatcccacttggcttgcagtaataccaagttcaagaccagcctggccaacatggctggtggggccaggggtgcctcgttactcttcctatgtggcttccacattgcagaggaggcaagggggctccttaccactgggaaagataaagtcccagctccctgcccggccttctctgacgctacccttgtggagctaaggggtgccttgatacagttaggccaggatggaagtctagggtccctgctcagccttttctggagaagagtggggatggggccacatttttctctgtggtgttttgctgcagtagggtgggtattggctaaagccttctgtcttgctacactgcctctttccccaccctttggctagagagagcagctttccttggggctttttggtctgctcccattggcatttctgggttgctgtcttctccatctgggatatattaggcaaaaagaaacccaggaattcaccagagagtcatttctcagctctcaagattcctagtaagtctgtcttccctcctttcagagccttctgtttattttatatagtaatgtccagggctttagctgtacttagtgggaggaataggcagaaagtgcattattcatcttgttccagaactgtaaattcagccttttttgtaaaggattgctttggtggttttgtgtagaagtaactatcaagggtcataggcagcagcaagaaaactgatgtgggaggctgcctccagggcgctggggtccccatttggtgcatagcccctgcttagctcattagaatgagccccacaagtgtggcagaaagtggacgtgtgctgctcatgctccgctagcctgggaagaggccagtgtcagggcagcttcccatggcaagcccttgaagcattgctcgctgccacaccctgtttcctcacggtctctgttacaggagcgaatccagccacagacctgagaggcgcaggcttccttgccctcctgcatctgctctacctggtgatggactcaaagaccttgccgatggcgcaggagattttccgcctgtctcgtcaccacatccaggtgagactttggtgggaagccagaggaaaggaaagggccgtggagctaggacctgagtggccgagagggctcccaggacagctgagataaaccaggaatgggcttccccgtcagtctgacctgcattgaaatatgagctgtaccgctcattagctgtgtagctcaagcaagttcctcgactcctcagagccttgattccctcatctgcagaatggaaatcatagtgttgttagaaatgcttgttctttggtgccgtaaagaaatagcacttgaacataaatttaatttcttcagcaaggattttttttactttctgcagaaagggtacactcactagcagttttgccacgagagtacactgaataaatgagacaggatcatttataacttgacccatatactttactgctgtgtccggtttctattggctggaatgggacttcacattcgtatttgtcttgattggctagcaacttagaactttttaaaagaagcaaaggaagaggagaacaaaggaaggaagaaataacttgtggaatgctgagaaaggtaaaaacaccttcaaataaggaagaagaataggctatgacttaatgcttgcttggaccagtataagcatgccagggcaaatatttaggctaaattgtgggagctaagaacataaagtacagtgacttcttcattatggctagcagatatttaagaacgttagcagaggtctttgaataaattttgcttctaagagaagttactatttatcttaattagatggggaggaaagtctttgaagaggaacgtctactttactttttacagtgtgaccctgaaaatctgaggtctcagttaatttagaaagtttattttgccaaggttgagaacacatgcccgtgacacagcctcaggaggtcctgatgatatgtgcccaagatagtcagagcacagcttggttttatacattttagggagacatgagacatcaattaacatatgtaagaatgaacattcattcagtccagaaaggcgggacaactagaagcaaaagcgggaggactcgaagcagggaggggactttcaggtcataggtagataagagacaaataattacatttgagtttctgcttagggtctccaaaggaggcaatcagatatgcatttatctcagtgagcagaggggcaactttgaatagaatgggaggcaggtttgccctaagcagttcctggcttgacatttccctttagcttagtgattttgggggcccaagatattttcctttcacattttcccccttttcttttttaaaatcttttggagaaagcattttagaagaaaatgaatctctggtcttaggtttcatctgatctcttacggctaggatggtttattcctagacggataggtccccgagttattaggaaagttcatttttagaaggttgtgaagtctcatgtcctatgaagagaaaatacggggaggaagtgaaaacaacaacaacaaacaaaagaacaatcctggatatcaatataggccacattcttctgaagtctatacatcagtaggcaggtatgaaagtggcttatgtatgtaaataggttgctgttattttcttctgaagttgtctggcttcagtttgcagggctgtaagaaagtacggcttaattttcagtgactccaaattaggaaaatggaaaaaaaaaggaggaaaagaaatttaaaacattattttgttttgttttgttttgtttttttggagacggagtctcgctgtgtcctgttgcccaggctggagtgcagtggcgcgatagcacactgcagccttcgcctcccaggttcaagtgattctcctgcctcagcctcctgagtagctgggattataggcacatgccaccacgtccggctaatttttgtatttttagtaaagacggggtttcaccatgttggtcaggctggtctcgagctccagacctcgtgatctgcccgcctcagcctcccagagtgctgggattacaggtgtgagccaccgtgcctggctgaaaacattattttgaagacttgtagccaagaaaaattagaattcagcccaaactgtagaaaattattaaaattgaaaaacattaggcaagactaggatctaatgacaggtgtactatagtttttgaaacataatttttctttctccagtttcctgtttttactaaagacaaatcatggtaggaccgatttgctttataatacttagccagattatttgtataaagtacagcaagaatagttatttttcacataggctttttttaaaaattggctttgatggaactttgttatatagaaggaatctcaggcaagacttttttttaaagccaagccttgccatggatttgtaccatcaaatatctatgagttgggtgaatttcctctcctcttgaggttccaggataaacctggggctcctgggcctgccataaagtaacattctttacttaacacaagtcagaaaccctgttcagggactgtgtacacaaaatatgaggccagtttcccaagggcgttattggcttcataaatcaagtttgagttcttaaaagaaatgacatggttccagtcaaagccttggtaaaataattagtttctccagttgtgtcctattagcagtgaaaacagattcttattgtatttatgcaaataactgtattgccataaattaagaatactcacaaatagtttccaaattctggagaactcaggtagagagaaacaaatatgttccaaattttggtcatagcagtatactaaattgttaaaagctgtcaatagctcaaaagagaagtttgaagactctgaaaaacaaaacaaaggatcagcaacgttttaagcaaaaggtcaaaaaaattagttcaatccatgcagttaattcctgttctgctttgatattcatgaacattttagctctccatgagtctgaaagtttttcctctattctgatgtcacaatctccaaagttatcagaaacctgcattcaagagcccctgttagagttttaagatgatgattattatttatttatttatttttagactactcttgctctgtcgcgcagggtgaagtgcaagtggtgcaattttggctcatggcaacctccacctcccaggttcaagcgattctactgcctcagcctccgagtagctgggattacaggcacctgccaccacacccagttaatttttgtattattagtagagacagggttttgccatgttggccaggctggtcttgaactcctgacctcaagtgatgtgctcgcctcagtctcccaaagtgctgagattacaggcatgagccaccatgcctggccttttatagctgattataaaaccaccttctaaagaggaccaaacaacacaacaattgtctgtggatgacaaaaagttttagggaagccattgttgaagacccagttgacaaggaaatttgttatctctgtggcacagaataatttaacataacaattataattattactgataatgtacactaagttatatcagaattttaggagtttcccataattttggaacacataccaataacacatttatacaaatacagcccaaagaaaatcgtacaccatttcatatttgacaatgcttcctgtataatttttataccaaataagccaaattatgtcatttttggactttatggagcctaatatcttaaaggatttatcaggtcagaaaaagacataatttatgatttgattttggaaagtttgtcaaatatcaaaggtttaaaacttgatatcacaaaataggatcacaggtcattataagataagtcattcttttaaccaaagcaataactcaaggatttcaaaaagaaggtgaaaatctccattccttgagagcggagacttgatttttcaatcaataagccctaataaaaacagcatgaagccaattaaatttatttttcaaaattttgtaaacaatctataaaattttaatcttgaccataagatataacttccataagccttttataacctttataacctttattaaggggctggttaatgcttcaagaaaatcttgttaatctgatgcaggggctcatgtgctgcttttgcatcagtgtgcctttgacattcatgattaatttataaagaaacttaacctattttatctttaaaaaatcagctcttgcaatctcatgcacccacctcttccgcaatagtccctgggccttgaagagttgagtagctttaatttctggccccgtgtcttaggaatgcagtttattctgattggcatcttctaccaggcctgaagatgaggctttaattgctgtcaatgtttaagatttgggctgggcgcggtggctcacacctgtaatcccagcactttgggaggccgaggcaggcagatcgtgaggtcaggagatcaagaccatcctggccaacacggtgaaaccccgtctctactaaaaatacaaaaaattagctgggcgtggtggcgggtgcctgtaatcccagctactcgggaggctgaggcaggagaatggcgtgaacccaggaggtggagcttgcagcgagccgagatcttgccactgcactccagcctgggtgacaaagcaagactccttctcaaaaaaaaaaaaaaaaaaaaaaaagatttggcaggacatagggctgggtgcagcggctcatgagtgtaatcccagcactttaggaggccgaggcgggcagatcacgaggtcaggaggtcaagaccatcctgcctaacgtggtgaaaccccgtctctactaaaaatacaaaaaattagctgggtgtgatggtgggtgcctgtagtcccagctactcagaggctgaggcaggagaatggcatgaacctgggaggcgaagcttgtagtgagccgagattgtgccactgcactccagcctgggcaacagagcgagattctgtctcaaaaaaaaaaaaaaacatttggcaggacacggtgttccttttagacccaggagttaaagccctgtaactcaatgtcacaaggactttttttttttgagacagagtctcacttttgtcacacaggctggagtgcagtggcgcaatcttggctcactgcaacctccacctctcgagttcaagtgattcttctgcctcagcctcccgagtagctgggactacaggcgcgtgccactatgtccatctaatttttgtatttttagtagagatagggtttcactatgttgaacaggctggtctcgaactctggacctcaggtgatccacacgccttggcctcccaaagtactgggattacaggcgtgagccaccgcgtctggccagcactttaaaagcacatacagaaagatacacggatgtaataaccttaatttaaaaacaagacaattcagttacttatctagggatgggtctcgggctgtagactctaccatcccagaagcaggaaaaaaaaaaaaaaacaaaaaaaactcatcttccctgttagaagtgagctcaaactccataaagaaattacctgccttccattgtcatggaaacaggaaatcttaccttccttgttaaaagcaagtaaaactccaaaaaaaaaaaaaagaggagttgtacaacaaaataaactttagatcttttttgtttttttgtttgtttgttttgagatggagtttcactctgtcacccaggctggagtgcagtggcgtaatcttggctcactgcaacctccacctcccaggttcaagcaactctcctgcctcagtcttctgagtagctggggttacaggcgcccaccaccacgcctggctaacttttgtatttttagtagagacagggtttcaccatatcatattgcttgatcctgggaggtcgaggttgcagtgagctgtgattgtgtcactgcattccagcctgggtgacagggcgagactctgtttcaaaaaataaaaataaaatggagggattgctacattttgctacttgagaaaaccataaaacccaaccccagagggcaggtccagacagagatagagaagctactggtctcaggctggtcttgaactccttacctcaggtgatccacccgccttggcctcccaaagtgttgggattataggtgtgagccaccacgcccagccaaagatcttgaacaaatttggggagatcagggattctctggagggtgtactcccagacctcagcaaattgttctgttgttttgagccataaagttagctcatgctggtaccaagcatggataggagatttgtcaaaggccaggggtacctccactcagaatccctctgtggttaccaaaatgtgaaccctgaaaatctgagacaggtctcagttaatttagaaagtttgtttttccaaggttgggaatgcgcacctgtgacacagcctcaggaggtgctgatgacatgtgcctaagttcatcagagcacagcttggttttacagttttagggagatatgagacatcaattaacacatgtaagatgagcattggttcctccggaaaggtgggaggactggaagcaaaagcgggatgactgaaagcagggagggggtttccaggtcataggtagataagggacaaatggttgtgttctttgagcatctgattagcctttccaaaggaggcaatcagatatgcgtttatctcagtgagcagaggggtaactttgaatagagtgggaggcaggtttgccctaagcagtttccagcttgacatttccctttagcttagtgatttggggaacccaagatattttgttttcacaatagaaacttcagctggctcattgggaaaattagagacaatgtacaaaagtagcaagcacagctgtgctgttgctgtttcaactctctgccctccctgaggaaatgccttgcacaggggtagcatctcttggccctgaaagagaagagttagcctccacgggcccaagaggaggagatggacctccatgggttatgtgagccacagacttaccaacaggccagaggtgcttcagtagctcctctgtctctgtctggacctgccctctggggttgggttttatggttttctcaagtagcaaaaggtagcaatccctccattttatttttattttttaaaacagtctcaccctgtcacccaggctggaatgcagtggcacaatcacaactcactgcaacctctacctcccaggctcaagcaatcctcccacctcagcctcggctgggactacaggtgtgccgtaccatgcccagctaattttatttttttaatagtctctccattttagaaaacaaatttgacctgtttcctgccatctgtctatcccatattcatgggacctaggattcattcattcactgaatgaatattttttcagcatcccttggtgctattcttcttggtacttgggatacatcagtaaataaaacaaagattcttccagcagagatgaccataagctcaatatatcaatacattatagagtgctctagaaggtaataagtactaaggaaaaataaataggatagagttgagagaatgtggagagacagttacagtatttttatagggtggtcagggtagctgtcatgagagagtgagacttaaaccaaaccttggaggtgggaatgttagccaagctgatatctgggagaagaacataccaggcagagggattagctagaactaaggtctcaagaaaggagtgtgtctagcataggtaatgagtagtagggaagccaccggagtgaaaagaacacaggaagtttcactcatgtctgtatgaagagaccaccaaacaggctttgtgtgagcaacaaggctgtttatttcacctgggtgcaggcgggctgagtccgaaaagagtcagcgaagggagataggggtggggccattttataggatttggttaggtagtggaaaattacagtcaaagggggttgttctctggctggcaggggtgggggtcacagtgctcagttggggagcttttgagccaggatgagccaggagaaggaattttacaaggtaatgtcatcagctaaggcaggaacaggccattttcacttcttttgtcattcttcagttacttcaggccatctggatttatacgtacaggtttgggcccagaggcctgacaggaagggcagtaggagaggtggtcgtagatgatgggccagagggcgcagggcctagcaggccatggaaaggactctaggttttacgctaggtaaaatgaggaggcactgcagggctttgagcagcagagtaacacagtctaacttactttttttttttaatggatcctaccagctgctaagttaagaataatttccagtgagggcttttgtagtaaattagagatgatgctggtttgtcaatctccccttccagcagaggaatgtgtgggtaagagagtcacaatgtttctgaacaaagccatagctcctaagtggtgaagctgggcctagagcccctgtttcctgacagctggcctggcggtgggctctgtacagcattgattcccagccagcagcacaccctgaaaagtcacatagcagtgggagtgcagatgcttagactctccccatcagaaccactcagttggaatcttcagggttggggccaggtcagcagcagccgcagaagatactctggtcttcctgcttcagcagacaaaggtttctaagcccaaacgtgaggcatgaggataaatgaaattgtaaatggaagcagaaaaatgtccaggtctgagttcctctgctgtgttttagtcagtttcagtgcagtattttagctctaaacaatgctttttaggtctgagggaactgctgaaggaaaggagacatttagatctgaaatccaatttttaccattttttgatacgtaggctttttttttttttttttttttttgagatggagtctcgctctgttgccaggctagaatgcatggcacaatctcaactcactgcaacctctgcctcctgagttcaagcgattcttctgcctgagcctcccaagtagctgggattacaagtgcccaccagtacacctagctaatttttgcgtttttaggagagacagcgtttcaccatgttggtcaggctagtcttgaactcctgacctcaagtgatgtgcccacctcggcctccaaaaatgctgggattacaggagtgagccaccatgcctggccaatcagtgggctttttaagaatgttcccgggctgggtgtggtggctcacgcctgtaatcccagcactttggaaggccgagacaagcagatcacctgaggtcgggaggtcgagaccagcctgatcaacagatcaacatggagaaaccttgtctctactaaaaatacaaaattagccaggcatggtggtgcatgcctgtaatcccagctactcgggaggctaaggcaggagaatcgcttgaacctgggaggcagaggttgtgggagccgagatcgtgccattgcactccagcctgagcaacaagagcgaaactccgtctcaaaaaaagaatgttcctgagaatggatgaacactaagttcaggtcctctgttaataatgttgttaccatactgtttttctcatatttatttttagattgaaagaaatcaagggaagggatgatattatgcaagtatatatgatcattaaataggcaatacctgaaggtacagaggtatacatgaaggtcagcatcaatggtgttctcagctacccatgttgaggcaagtataataacgacgaacatttgttaatacctacttgggccaggtgttgtgcctagtactttgcacatgtgatcttaagtaatgctcacagcaactctgtgaggtgggtagtgggataaaatgttaagtgttgacaaaatctgtctcataaggccaggcgcagtggctcatgcctgtaatcccagcgctttgggaggctgaggtgggcagatcacttgaggtcaggacttcaaaaccagcttggccaacatggtgaaaccctgtctctactcaaaatacaaaaattagctgggcgtggtggcacgtgcctatagtcccagctatttgggaggctgaggcaggaaaatcccttgaacccaggagacagaggttgcagtgaaccgagatcacgccactgccctgcactccagcctgggcgacagagcaagactccatctcaaaaaaaaaaaaaaaaaaaaatctgtctcttggagttgttgtaatgattagtgacttaactctacccagtgtggcactagcgctggatttccaagaccacctgcaggttcaatgattcctgagagactcaagggactctacgtatagttatacttaacagttctgatttagtacaacagaagcaaaatcagcaaagggaagaattacatgggacaaattccacaggaaaccaggtggtgatgtccaagaggcctctcccagtggaatcacacagaacacacttcattcttccactgccaaattgtgcaatacgtataaaatgtcaccaatcagggaagctcattagaggtacccagtactcaaggtttttaccatgacatgctggtcatgtaggcaccctctgcctagcacataccaaaactctggaatcacagagggaaagctggtgttctgcataaagtatcttttttgtgtttgtttttttgaaaaaaaaaaaatttttttgtagagacaggatctcaccatgttgcccaggctggtcttgaactcctagactcaagtgatccatccgcctgtaatcccaaagtgttggattgtgagccctgggcccagccagcaaaaactatcttgtttgcatgagcagttgaggaacaatgttagggaatgatgggaaccatctcaaaatccaagttctcagctgtcagccatggcctgatctaagaattttctaaggctcaggctctaaggagtctcaggcctgctgtgttaacttttttctgcacagcactcaaagtttatgtcctttttgattttgagagatgggaagactgagtttcacagaggttgggtgaccttctcaaggacacacagctaccaggtagccaggccaagatctggaattcaggtatcatggaagaccctgagaaaaatctctgtggagccagaagaccttctgcagttcagcactgtccagaactttctgcagtgacagaagtggtctagatattggaaatgcaccatccagtacagcagccactaagcacacgtgactactgagcactggaaatgtggctagtaccactaaggagctgaatttatatttgtttttcatctttaactcatttaaatagctacatgcagctggttgccaccatactgggcagtacagttctatactataatgtaatggatttttcttcaactgggaagcaggtgggataaatagaccttggttcttgttctgtactaaggaatgcactggtctatgtgttcctctcactgggtgtccttgtgtatgtgcaacaggggaaaataacatgtcatgtctgcaagttccctgaaaaaaaggccctttccattcagggattttgcaagcttggtttcattgttattaaagaaaggagcttgcctgactaaacatagagcattaaagctgtccctgtaggggattctgaggcccttcctggtgaagctcccctgccagactcaggctgcctcctcttggggtctgacccgcacagctggctctcaggcctctgtgttatcgtgagatggggtgtccccccaagtcaggatgaccttctacccacgtgcgtcttctctgtcttaggatgaggtgctcacgatcagccagacaaccagaagcccaaagaaggggagaggagactttaagaacccgtagggctagttagagcaccgagcctctcacttctgtcttcatcctgacaccaggagatgatgtgggcccaggggttgggtctgctgcaggccaaggagagctgacgggtcaggatgatgaagaggctggagagctagcacgggggttatgcacatcagctctggagcaaataacctcagttggtatcctggttcccatgccttaggaaagttactaaaggtcactgagccttagttcctcatctgtaagatgggaagaagattattaggaaaattaagtggaagcaataataatatcagctgttgcctctggggctgtgcttgcctgcgagccacaccaggctgcagatgacaggaaacacagtgagagctggagttgctgctgactgggtgcccctccattccagcaattccctttctgtttgatgtccgtgaacatcacccacattgccatccaggccttgagagaggagtgtctctccaggtgagtccccaaacaccagctggttagagtgacccagcaaagccttgttcgtccccactctggcttaattttccccagctctactccacctgctggctcctggagggcctggacaaagtccccatgcaccggtctccccaggacatcccttctcccacccctggccttagatgtcaggctcctggggaatggtgggggcatcctgggtttgggctggctcccctggggaaatggggaaggaaggcgggagggaacctaggtctcagccttcatccaccgctgagcaggtcaccttgcctttttcctgcagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaattaa

SEQ ID NO: 1592 - DNA, 37033 bp, Homo sapiens; identical to SEQ ID NO: 1591

SEQ ID NO: 1593 - DNA, 37033 bp, Homo sapiens; identical to SEQ ID NO: 1591

SEQ ID NO: 1594 - DNA, 37033 bp, Homo sapiens; identical to SEQ ID NO: 1591

SEQ ID NO: 1595 - DNA, 217831 bp, Homo sapiens
cctgcgtgtccctctgcgctccgactggtgcgacttctccctgcgctagcgaggcagggttttggcctcgcctctcgcgagatcgcctcctgttgctgccgccgccgctcctggccactgactggcggcgcctgcgcagccgccatgttcggttgctatgctgcggcctaggagagggggtgtgcttgagggaggaggaagagatagaggaggaggagggggaggaagaggaggtggagaaggaggggggtgactgagctcctcttgcactctcacacacaaacgctgcccaggattacccgccagctcacgccgcgcagtgcgcttttccgctcctcgcgccccaccaccaacattgttctctcaggactcctgggtcccaggggccggaattgggcctgagcgggagaggaaagagacttggctttggccgcggggtcggaggattggggccaggccccctcccccacgcacttttgggggtgtggattatctcatccctgcagggaggtaggagaggtcgccggctgcccgcctccctgccacctccccagcggcgccggcccgcggctgcccagcagcatgaggtggtgctggcggctccgggtcgtggcgcgaccgctgcggcggcggctgctcggggggcgctgaggtagccccccggagcggcacggaggacgcgcttctcctctgcgcgccggggcctcgaggctttttttctccagccgagaggacgcggctgtgatatacgaaggtaagaggttctccggtccccgccggcctctcggccctgcacgttgaacgggaggctcttacctgcatgtgtggctcctgggaggtgagccaggtggggcaagccggaggtacgaggatgatttgaaaggaaggaaaaaaggacaaaaacaaacaaacaaacaaacaaaaaaacgctttctttcctttcttcctgggacctctgcttttgcgggggttatagttggaatctctgttatgggtcagcgaagggccaagggatggaataggtgcggagatggaatgttcccagtacctaaactctaggtaaagctttggaatcttgagttttccattgctggtagaattccttttttttttttttttttttttggctcatatgagcgcttcttgcacgctgcatgagccaactattcctaccattgaagttttaagcctgttatgattctaccagtatatacctgtatttgggaatctgtagttgagccaaaaaaaaaaaaaaaaaaaaagttgagatgtgggtaaacagtgatgcatttcgcagggtttccataaaatggaacagcttacagttgcacaggtgatgtgtggatgtttctgcaaaacttagggtggaagattttatgtctgggcttgcatcatgtagtgacatcagtatgtacaaggacgatttgtaggatttttcaaaacgcctgttctaggataacttgttatgcatctgcaatatgccagctgcttttcgaataagaggtttcagtaatactaagtttctgtgtccagatcttgggcccagttgaaacagtacagctgattggtcacatttaaaacatatttatggagaaagataaaaggccaatgtgtccgacttgcaaaagacaattagagtagaaagaagactggaacagtaaaagccagggcatttttaaatcttggttttctgaactttaacgtgccagaggaaaaaaattttttttcaattttaagggggaaggagatggccttaaaataaaggattgttcagagcctaaactgtgcttaatggaatagagctaggtatatcatctaaatcttgaatttgactaatataaattcagctttcttttaaagaaaaaactcgtaagcagaagtttgtgtattctacagaacctcttcactagctcgtaagtgtgatcattttgtggacatcactgtttttttgttagaataaatttatgctccaattaccacaaaagcaatttttatgtctcttcgcattttttatggtacacatatctttgttacattttgcattgaaacacgcacggtcccatagtatcataatcttcagtgatttataagagaaacagtctattttgtacatgggaatgtttgtcatgttgccagtctgttttaaaaatttggcaagaggtttttaaaatccaaggaggcaccactattttgtagtttttaaaaatattaattgagtaggtccatgtttattaagttagaaaatcacgagttcctcaaaagtagtaatagacgaggatgtgatttttcttactgcccattttctaacatcttagcttcagagctgtaggtattgaattgagtcaaacttgtgtttttttcttatgttctaattaaatatcttttaaaatgtccctagtaacattgttactttaaatttataacacccaatttctaatttaggctaggcataaaaccagcattgattgaacgtacttgctaaaaatactttctgggtcggatgtacttagaatgcagcctcaggaaatttcatttgaactattctgtgaccagtgtacacttcattattgttgaaggacttttaaaaaaagtatagatctctcatactcgatttaatcagtttgagcatagatgcctaactttaaaaaaaaagtataataaagtgggatagtaatacaatttacgtgagatggtaataaaaacttttcagcttttttttttaacttgtatgacttcgttaggttgttattaaactgtgatttgtatttttaaaatagttttgtctgttaaacataattgaggtgtacagtacagtatccattgttatctgtttagtatttatttatgacttacaaactctaaaagcgggatcagtgatcatggtttttagtaagttgtctttaaggagcaaagtaagagactagcagaaaattgcaaggaggtttgttattgagagtacttctgccccccgcttgagagttaatatggccacttttaaacaagaaaagttttccagaaacgtggaaatcttgtttggtgtatgtttaggggcaaatgttttaaagttttgcctaaattcttagttagaatgcaaaattgatcaactccctaggaatggttattgtggctaaatatgaattgttgctcctatgtaaaatttagttattggtagaagtttactaactgagttgaattttgttgttttcctgggttattgcatgttatgaagttttttatgtactataatccagatttgttaaatttgccagtttactagaataagctgtgaagccttgaagtttggcttagcattctgaaaatcctttttattgtttgccaggaaagcactgtaggaaggaggtgttatctcttcatttaatatttaatgagtagtatagatgatgagataggatataatgtagaaataccgtagaatcttctttattgatatgaaagtaccattgtctaggaacagcataatttcttatcttttgcatgaatggggaaaaagaggaggggaaatttattagactctttcatttcattagagatatcttccctcacattcattcttcatttcattattcttaagtagaaactttggaagagagatgcaagtatttgaattaattagtaagaacaaaatgaaaattacatcgtatagactatcatgaggaaaatatcaatttgggttggttattgtgtttgtattttttaacaaggaggttatatagagtagtagaaagaaaaaaggacccagaggggaagagtgttaatatttattgtctgttaagtgtcagatcctgtataaggggcttttcatgttgtcccactcaccaagtatgctttatgaggtaggtattattaatcccctgtcctctccctgccaaatagaagctaagggaaatgaaataacttgtctaggctcatacttctagtaagtggaattctctaaaacttattctttagatcggttctgtccaattaaactttctgcaatgatggaaatattcttttttccttcaactttattgaagtataattgacaaatatcatagaaatattttttgcactgttagttatggtagccattaatcatgtgtggctatggagcacttaaaatgtgacgagtgtgtctgagaaactcaatttaaaattgtatttaatttaaatcaatttaaatttatagccagatgtggctagtagctatagtattggagagcatagctttaggtctgactgcttagaaaatctgagttgtagtatttaatcttccactggtttatgcatggcattgggcaagttgtttagttctgggcttcagtctaatctggtgtgaaaatgaaggggtcgccactaagagattatctccaaggttccttcttgcctgaagttctgtgactgttattaaaacatacagtagcattcaatattcacaagcattatgtctgaaaggatcccctccccaatatgctcacccattacctaaagatttctgtttagtcagtttctctttttgagaagcgtatgtataaagcacacataaaggatagtggattattccccacctccccaactgttcggcaaaaacattgtgtaactcaaggcagtactttatgatggaacaaagtttgaatctttaaaggccatattttaacatgccaccttcccgtttaaaaatatataggagttccccggtgcttatcaaattaatcccaaatttacctgcttgaccttgaagactttctaccaacttcatctcattaaccttgtttctcattcgtgcttaaaaagaaaatagtcttgttttttcctttgtcctcgtttccataatttaaacatctctgtctccaattcatgtgcctcctctttaaacctttttcaaaattcacctgtttctggaagaatgctgcttaatccactcacaaggatcagttaatgaatcctggtaataagtaccctaaggttaatatatgcttgtttagatatagtttaatatcttcttaagctttttttttttcttaagtttttatgttacctactctgtttccttaattttcttaggttaaaaaaattaaaataggaatagcgtcttttgtattgtcttatgaatttagttcatttttcaacaatgctacttttaaaagttgctaatttttaaaaaggataaatactgtaacaacgtttacccttgatcaccaccataatagctattttttgtttctttccaggtaattgttcatatttaaaaaataaagttgtgtggtagagagaattttgagaggaatataatgggaacattgtatggtggaggctgtgcaatgtaggggaaagatcacagactttggagtcaaatctggtgtggaatctagcgtcaaaaacctcgggcaaactgtctgatttctgagtcaggagtcaaatctggtgtggaatctagcgtcaaaagccttgggcaaagtgtctcatttctgagtcaggtggtcttgaattgtggggattaagatactatatgtaaggcatctagcgctgtgctttaaatacaagagatgatcagtcagtgatagttggtattattttttcatttttctattcccatcttcatgaatattatttatttattttagctacccaaagccaccaaggtcaatgaatataatttaagtgattagttaaacattcaggtgatataccataactgatttagacatttacattttgttaagcggttttttgtttatttcctcagtttaaaaccctaggactgggataatggtcaagtgtcatgaatatttctgtgccagatctctctcttacagaagtacctacagtggttgttcttgttttgggaagaaaaaaatgctaattttataattgtatttcattgttttaattaatgtaatttgaaaatttatttggtgatgatgtaatgaacattcctttatatgttaagcaaacatttgaaatgcccattgtagtgggagcagtggtataaaggtaaataagacatgattcttgtccttgagctcaaattctagggtggtaacacatgtcaacaaacaattaacaattcatagtgacagtgtaataagatctggggaaaagaagtggcatttgaatatggtcttggaggatcatttggaattgatctgggtagagagaacagcatatagaaaaagtcaaagtatgaaagaatgtgtggtgtgtttggagaaatgtaagttgtcttgttggatatgtctgtctctgtctgggtgggtgtggttgtctgttcctgtgtgtgaatctgtgtgtgtgtgtgtgtgtgcgcgcgcgcatgtgcgttgattgcagtgggaaatgaagtcttgtgagggtccttgtgtttgggcaatgagtgggatcattttaagacctttaaaatagagcttcccaactggtgtgccatgaatggtttaccagtgtttcggagagcaagatacccttgtttaatgggacctgggcatatcagatccccctccccaccctgccccaggatggtttcttttggctttgaatagcatttgtggcttatcccaacgtgctaagaaattattattttctttgttgccaagttgggaaaaggattgggaaaaccactgttttagagactgtaagtattagaaagtttatggttcctactcacccttggcatccactatggaatcagaaataaatatcaaatcctaaagtaagcttaaggtaaacttaagaattcttaagtcaccttcctctttctctctctttttccctccctttacccgctgcctcccccatttcactggtgtatgcgcatgtgcgcgcgtgtgtgtgtgtgtgtgtgtgtgtgtgtgtgtgtctgtgtgtgtgtgtgtgtgtgtgtgtgaaatatctctttggtgcccttgcgttactggtgccctaaacatgcatttagtctgcctcttgggaaatcagcattaacattcaggaacaatttagaggtatttaaataagggatgataagattagatgcaggttttgaaaggtaactcctgacttctagataatgatgcaaagttacaaggataatgcaaggatgaggttagaaatggagcagagagaccagatgctgttgcagtggtccaggggagggatgataggaaccagaaatagggcaatatagatatgagattagaactgaaaactgagtagtttcactagacctgagagtccatttggacatggggggaaagagttgaagatgatgctaggatttcttctttggcagcttcccttctttagcaagggaaggccagattatttttattgagcacttccagtgagccaggtattttgctagacagcgaagttgtcacgagttctcatttaacattttgaaataatttcaaacctaatgagaaatctcaagaaaagtacaacaaagagctcctgaatcgccttaaactaatttttaacattgtactagctatgtaccgtgtgtatacacagctcaagatgagcctggaacacctcgtgcttggctcagtaaggccttttccagatgccccaagtggtcaccttggaattgtgtttagccctttccctttttctactgtatctaattggatcctcaaatttcagtgaaacaacctcatcatctctcatttctggtcctacattttaatccttatttctccatttcaggggaatgcaccatttctaatttcatttggcttttttcctgaattatttgagagcaagttgcagacatgatccctatcactactaaatattttagtgtgtatttagcaaaacaggacaatctcctacataaccgccaaatcaggaaatcaacgttgatataacactaccttcaggtcgaacctagatgccattcaaatttttccaactatcccagtagtatctctcttttctttttggtccagcatccaattcaggttcacacattgcatttaattgtcacatcttttagtttccatcagtttggaatgattcctcaatatttccctgtcctttatgaccttgacagttttaatgagcagagtcctttttttctgttacatgttttcctcaacttaagttcatccagtggttcctcatgtgcagaccgagtgcattgttggcaggaatgccatagaaataatgtcgtgatattcttagtacatcactaagagacgtgctgtatagtcctgctactagcgatgtttaactttgaacacctgttaaattcaagtctgctgggtttctctactgtgaagttatcgtttttttccttttgtaattgggaattcttatgtgagaagatatctgggagtgtgtcaatagagctgaaggctgtaaccacgagccttcaggtctgatgattgctacctgaatcagccacaactgtgaaagttgtcacctacatttattagttcatattctactgaaagaagattttctccttcttctccatacatttatttattcattcatttatatcaatatatactcctggatttgtttctgtttagtggtttatattagttactgtcattttaaaatttcattttgttggtcaaattgtcccaaatttggcctttaagttggctcctctatctccttgacctgtccccctccttggtgtatttccttactttctggcctaacaagatgttccagatgatcttaatactctcctatcccagctctgaaatcatttatttttccaaggaatcctgattttattttacttttttaagtagagatgctatttaggaactgagatccgagtgttcagtgtgttcatttctgctggcatgtcatcacttttagggggatagagctaggaaatacatatatgtatacacacatctgaatctgtttctatgcctatgtacaggtattttataagttcacactgatacaaccaattccaatctaacatctcaggattcgtctagccttttccctttctgtatttgtaaatctcttctccagcagtgataaattggttcctattatctcctcagtgtatttacttatttgctcaatccccttgtatgtgccagtcttccgaccccgcattagttgtctcctttctccttgcttgccgcctctgaggcctgtggcatggggtcctcagagcttgctgtcaggtccatgtaggaaagagaacttctcatttaatctttttcccctcatttaatcaggacagaaatttgttagaaaggtgctattcccagttttaaaaggagaacagagctgaaattcaaaaaggtctgtgtctttaggcatgttactgtgtaaatagctgagtaaatattttgcattcagattcgtctgatactgaagcatcttttctctcctgtactgcatagcctctgagtatctgtggaatccaaagtggcaggatttaaggttgtatagatggtagctgaagcaatgggtgggactgtcactgcttatgaagtatatataaagttaggaagaggcacactgacagagctcctaactaccatcactgaaagattaagggctctccgaaatcaagaagccagtgaagaagactgaaagaaaggttgtgagagaggagtgtggttgtgtgttagatgatggtgaagtaaggaatttcatgaagctgccatgttgctgagagaaaaagagaagaccaagaggctttgaatttgactgttggaaagttattgataatctcagctagttggttttccagtgtgttcaggcgagctgcctgtatcagaattatggagatactaatgaaaaatatgaactccccaggtctcatctcagaccttatagattcttaaaagggggagtggggagccaggaagtggtagcctgggaaaatctgctgaaatgctaaggttcttctgaggtgtactagtttgaggtttgttgctttagcagaagagttatagtggaagagtgtaataaactaaattgaggaaaccaagtgtacaatgaatatagatgagacagctcttcgagaagtttgccatagaggtaaaagatctcaggtcatggaagaataggggacagcatcaagaaaaatacctttgcgtttcaagggttacatacaccttaacatttgttgggattaagagaaggaaactgtaatggttattttaaagttgggtaagcaaaactaattagcaacacctactatcaaaaaaatgccctgagtgaactttgatatgtatctgggatagctgcctgctcccattttaaatgccatcttttggtaggtctttggagtaatccaagggtcattgtttattttgtttttagttaaatttgtatcttgtgtttttgttatacagttgtgtaaagagcttctctttgctcatttttatacaaacacgaattctaagtatattcttgtatatagacgagtcactagcaatacaattaaaaattacgtccaaaattggaggtgactttagagggaaatccaatccagggctaatttaatgtattctttgagcaccagctaggtactaggcactgtgcttggctgtggggatacagaattgaataagacatgctctttatcatcaagattattgttctttcttcagaggaacttgaaatctagtgtatagctagaaatggtacagataagtcatagataactatgttagtctacagtaaaataagtacagataagtcaatgtttaattaatacagcagtgtatattaccataattctcagacttgtcattttaaaattgtatttaaattgtattttcgtatttgaattggcaatatggctacatggttcaagtttcaaaataatataaaaaggcatataatgagaagtcttgataccactccttctctttcctgttctgtataggtaactacttttattttttgtatattctatggtatttatgcaaatagaaacacatataaagattactgttttccccctaccttttttatgtagaaggtatttactatattaatgctttgtaccataatttttaaatttaaaatataccttggagatcatttgacttcagcatataaaaagctgtccctttcttcttctttttaaaaaatatagtagtatgttctattgtatagatatactattaagctaactaattctaattatttaaactttaagttttagacccttttacttgtgtaacccatttcctttcacctctttctgtatgaactagtgctccctgaagcattttacattaatgacctgcctgacttttctgtatctaaagggtctaactttttttttttttttttttgagacggagtctcgctctgtcgctcaggctggagtgcagtggcgcagtctctgctcactgcaaccgctggctcctgggttcaagcgattctcctgcctcagcctcccgagtggctgggactacaggcttttaaaaatcttgtcagcttctgcttttactcagtagaaatcagttaccatgtaacaagtctgattaccttgagactcccatgctgtgaggaagcccaaactctcacaggagagaccagaaggccatgtggatgagtacttcagtgaggacacatgaaagtgatgccttcttggactttccatcccagcccagccatcaactgaatgtagatgagtgaatgatcccaaatgatgccagatgacatccagtgcagcagaagagctgcctaatctagcttttacccaattcctggccagggaattgtgagacatataaatccttattgtctgaaaataaataaataaataaaagtaggtttatttgagtgcagatctgtatctgttctgctctgtcctggttttctgtgttaacaatgtcctatttttaaattcctgtactccaatcttgtagctggagctctctgctatctactgtaagcattgcctgctgccatgtttccttactgtgtttttccgtgattgctgggataccacctgcttatctgacctctacaatgctaaagacctgcttgcctggatcactgcttattgtctggtactgtaagctctggatactattttctaactgcctgtctctattgcctctcatcatcattagcgagtttccctcttctcccctaattttccctatcacagccctatcagcccttgagttttagtttgtcaatgtgaaacttggcaaaacttctgaaattatttgggatgatttaaaatcttcttgatgttagttgttataagtccattatgccttgtctggactcttgtagtagtctttttaagtgcagtttgctatagttttgccctttataatctcctttacactgtagccagagtgatctgacattcatatctgatcagaattcttttgttatctctccatctctctataaaataaaatgaaggagttttccaaggggattaaagttatttgggaaatatcagtttttaagataatattatttttgtgtgtttcttttttagatacttgttcatgaaagcaaaatatcattacaaatgccaaggacttccaaattgtttcatttgcattgaaataagggaaatctttctaatttatcttactgtttccagcctagcacaaattgcagtcagttatagtggcttactacaagaagctgctagggaaaatggaatgtcttctttgggaagggatcgtgatttgaaaaagttctcttaggtgattctgatactgtgactcattttgtatctggctatttttatggcttttgatctgtgttatcataattgtttatgaaaagaatttcgtaaccaacagtttgttatatgcaattctgaaattcccacatccctaaaaagcccaaaagttttgttaactaatttggcaaccaaacttgacttatactgaggtgagactacttagtctcatttattccacttacagtgtacattcttcagattctctaaagaaattttattttatttttattttttgaggcggacttttgctctgttgcccaggctggagtgcagtgccatgattttggctcactgcaacctttgccttctgggttccagtgattctcctgcctcagccttccaagtagctgggattacaggctcacgccaccacacccagctaattttttatatttttggtagagacggggtttcactgtgttggccaggctggtcttgaactcctgacctcaagtgatccacctgcctcggcctcccaaagagctgggattacaggcgtgagccaccgtgcctggcccttaaagaaattttaaatagcaatatggttgaatacagggtgctgccctagaatcaagaatgttacttaatgtaaggtatctgtgccgtatcacctgtctgtgtcccagatactctgaaattcaaaacacttctgaaagtgttttgaagctagagatcttagatatgagattgtagaactgaaccaccaacttcctagcaatggaaagaagtggtactttgttttcttttgtatttctttttggtggtaatgtagttgaacattttttcatgtttattaatttcatttcttatattcttcaaattttttgttcatttatctgctagggtgaatagtttttcttactaatttataatatcgtagatactaattggttttctgttcattctaagtttttgtatctagcatattggtggaaaatgctacaagttgaaaacgcacatacagctgatgtttgaacaacatggatttgaactgtgtgggtccacttatacgtggattttttttcaataaatatatcggaaaaatttttggaggtttgggacgatttgaaaaaaacacagatgaactatatagcctaaaaatatcaagactttttttcaattaagaaaaaaactggctgggcgcggtggctcatgcctgtaatcccagctctttgggaggtcaaggcaggtggatcacgaggtcaggagttcaagaccagcctgacctacatggtgaaaccctgcatctactaaaaatacaaaaatttgctgggcgtggtggcgcacgcctgtaatcctaactactcaggagactgaggcaggagaatcacttgaacccaggaggcagaggttgcagtgagccgagatcgcaccactgcactccagcctgggtgacagagcaagactctgtctcaaaaaaaaaaaaaaaaactaaaaaggaaaaattagatgtcatgaatacataaaatatatatagatactagtctactttatcatttactaccataaaatatacacaaatctattataaaatgttaaaatttaacgaaactcacacagaccatacatggtatcatttgcagttgagagaaatgtgaaaaaacataatgatgcagtattaaatcaactgcacaaaattaaccatcttacataatgtattactgtaataatgtaataaccacctctatttctagtgagttcaggtgttggaagtatccatttaaaatgccatgtgatgctaatcatctccacatgagtagtttgtctctccagttaattgcctgtcacaataaaaagtgatcttttgtggttcttgagtattttttagctatgtttcatcatgtttagtgcaaatcataaaccttgaataacaccatggaacccatatgaaatgcagctagtgatgctggaagtgctcccaaggagagaaatgtcacaacattacaagaaaaagttgaatggcttgatatgtaccatagattgaggtctgcagctttggttgcttgccatttcaagagaaatgaatccaggataaagaccatttttttgttttgtttttgttttgtttttaaaagaaatctgtgaagctgttgctacagctacaccagcaggtgcaaaaatcttgcactttttgtgaaatacctttttatctcacattgaaaatgcagcttttatattagtgcaggattgctattagaaaggcacacgtatagactctaatatgatttgagtaaaagcaaagtcattatatgatgacttaaagcaaaagaaaggtgaaggatctaaagctggagaatttaacccaatccaaggatggtttgatagttttagagtttggcttaaaaaatgtcaggataacagcagcttctgccaaccaagaggcaacagatgagttcctaggcacccttaagaaaatcactgagggccaggcatggtggcttatgcctataatcccagcactttgggaggccgaggcgggcagatcacgaggtcgggagttcgagaccagtctgaccaacaaggtgaaaccccgtctactaaaaatacaaaaattaggcatggtggcatgtgcctttaatcccagctactcaggaggctgaggcaggagtcgcatgaacctgggaggtggtggttgcagtgagccaatatcgcgccactgcactccagcctgagcaacacagcgagactgctaaaaaaaaaataaaaagaaaatcattgaggagaaaagatatctgcctaacaggtttttaatgcagatgaaggtgccctattctgaaaaaaaaaaaaaaaaaaaaaaaaaaaaagccacaaaggacatttattagtaagagagaagtgagcatcaagatttaagggaggaaaagataggctaactccactgttttgtgcaaatgcagtccggtttatgatcaggactgcccttatctataaagctgctaacccccgagccttgatgggataaggtaaataccagctgccagtctattggtcatataacaagaaggcctggacaataactctttttctggattggtttcatttgtgctttgtccctgaagtcaggaactaccttgccagtaagggactgccttttaaagttcttttgatgttggacaatgccgctggccacccggaaccctgtgagtttaaccttatgttgaagtggtctgcgcgctcttccaaacacaacatttctaattcagactccagattgattagtcctaaggacctttagggctcattacacatgatactctatggaaaggattgtcagcattatggaagagaaccctgatagaacatcatggaagtctggaggattacagtattgaagatgccattgttgttatagaaaaagctgtgaaagccatcaggcctgaaactgtaaatacctgctacggaagactttgtccagatgttgtgcatgacttcacaggatttacaacagagtcagtcagggaactcataaaagagattgtggatatctatatctatatctatatctatatctatatctatatatctatctatatactttttaaaggttgaggatgaagggtttcaggtatacatcttgaagaaattcaagagctaattagacaccacaccagaggaataaatggaaaataacttgatggagatgagtgcttccaaaccagtaccagatgataagcaagaagatgtggaagaaacagtaccagaaaataaattaactatagacagtctggcagaagggttccacttattcaagactgcctttaacttcttttacaacatggacccttctaaaatacgggcactgaaactaaagcaaatggtagaagaacgattggtaccataatataaagatttatttatttattaatttttttgagacagagtctcagtccgttgcccaggctggagtgcagtggtgcaatcttggctcactgcaagctacgcctcctgggttcacgccattctcctgcctcagcctccagagcagctgggactacaggcgcctgccaccacgcccggctaattttttgtgtttttagtagagacgggtttcaccaagttagccaggatggtctcaatctcctgaccttgtgatccgccctcctcggcctcccaaagtgctgggattacaggcgtaagccaccgcacctggcccataatgtaaacattttaagtgaaagttttaaaaagcccaacagaaattactatgtatttctgtaaagttacgtggagtgtgcctgcctctcctgcttccccttccacttcctccacctcttctatctctgccacccagaaacagcaacaccaatctttcctcttcctcctcctcagcctacttaatgtgaagacagtgaggatgaagacctttgtgatgatccacttgcacttaatgaatagtaaatatattttctcttcgttaggattcttaacattttctttagctttatggtaagaattcagtatatataatgcatgtaacatacaaaatatgtgttaattgactttgttattggtaagatttccggtcaacagtaggctgttagtagtgaagttttgggaaagtcaagagttacatggagaaattagacagtgcaggggtcagtgcccctaaaccctgcattgttcaaaggtcaactgtatttatatggtaaaggagatgatcttgctcttttgctcaaaatcctttaacggcttccattctttcttagagtaaaagctaaagtttttactgtggccaaaaaagccctacatggtctgtggacctggctgtctctctgaccttatctttgaccactcttctttttcatttttctcaaggcacactggcctcctttttgttcctggcactggcagacttgttcctacttcaggtcttcatgtttgttcttccttctgccttgaacacccacctttctcccaagtgttccaggcagatggagtatgcacatggctcactcttttactttttaagtctctgctcaaaagcaaatttctcagccatggctttcctgagcaccctatttaaaattgctttcctactcctacatggctgttctcctttgcttaccacctcacattatactatatatatttttttctttcctcattataatggaagctccatgagggcaaggacctttatcttgttttgtttgtcgatatattcatgttgcttcttcctgtctggcacaatgtgaggtacttaatagatatgttgaacatgggaggggttagggaaaagtagaggaacatttatctaattgcctaacacatggacacttgattcgagcctttagttataaatattctgctaattctggtgtaactagagtattttatatatatttattttagagatagggtcttgctctgtctccttagctagaatgcagtggcatgctcacagctcactgcggtctcaacctcctagcctcaagtgatcctcccacctcagcctccctagtagctgggaccataggtgtgttccaccatgcccagctaatttttttttttcccctaagagatgaggtcttggcatattgcccaggctgatcttggactcctgggctcaaaggatgctctggtctcagcctctcaaagtgctgggattatagatgtgagctactgtgaccactggaaacagttgctttctgaaggaagtataaaaactctatagagaccggcattcttttttttttttcctctaaaaaaatgcactaaacctctaactaataaaatattttttgctagggaagagaggaacaataaagctttaaatataataccacatacactataagactgcctctttttagacaaaaataaaaatattctcattgactggtagtacttatgaaagattggctttattgttggaatctcatagggaggagaccaaaggacagaaatttagaaaatggagagggagagagggaaagaactagctggctgcttctaatgtttctagtacttaggtaatgaactgtagataggagaaagagtagttctttgactcactaaattaattaatatacgtctgttttagtaaataatttcactgaattatttagtttccatccctaactagactgagcttcttgagggcagagatctagatgtgtgcatatgtgtatctctagcatctagcactgtgtctagcaactaggagctattcacatacttacgtgaataaacaggtatattgaaggcataggtttagagaactctgtagggccttagtgggtcgggagtgtgtttctttcttgcacgcacagtactttaaatgctgaaatgtataaataggatatagtgagttgtaaaagattaaaataagttaaataaaaaaggaaaagccttaggtaaatcagtttgatgcaagaaatggcacaaattagattcctgtatttaatatatagttaatataaaatctattttgacattgtaattctttattcttatcaggtcggtaacaattgagtagaggacatacaaaggacattttgaaaatgctgtctgtacatcagtgaatcccagtgtaggtccagtgttacgcattcctgtttcagatgattgattttgcacatgattaccaggaatactttgttgtcgtataccatttcttaaataagaagcttcttatttaagttgttgcataatgacttctatataaatgtgtttggtatgtgtaagtacagagagagaaattttagagcaaaacctgttgctacatttgaattttttttccttctacagggtatcagttttatagttcatagttttggtagcactatcctaagggaatctggcccattctgttgccaagttcagttcacatggcttgagggaaccttctttgtatacagcgttataacaataagctaagttagtccattatcttatactaccagcatttgaatttataattacatacaaaacattgtgtaataaactaagttggtagcaaagcagatggtccagttgggaatattccatttcaaataagtgtaaagaattgtcggctgggcgcggtggctcacgcctgtaatcccagcactttgggagcccgaggcaggcgtatcacgaggttaggagattgagactgtcctggctaacacggtgaaaccccatctctactaaaaatacaaaaaattagccgggcatagttgcaggcacctgtagtcccagctactcgggaggctggggtaggagaatggtgtgaacccgggaggcggagcttgcagtgagccgagattgtgccactgcactccagcctgggcaacagagcgagactccgtctcaaaaaaaaaaaaaaaaaagatcagctatcgaggatactttttcggtgggtaattgattgatgatttttgataactgtggttttattgtgtatgcatttgttaagtataaaagcagaatttgaaataattcttttattttttgtttttgagacacggtctctctttgtctcccaggagaagggcagtggtgtgatcttggcttgctgcagcctcgatttcccaggctcaagtgatcctcccacctcagccttctgggtagttgggaccacagtcactcaccaccactcctagctaattttttgtattttttgtagagacaggacttcgccatgttgcctaggctggtttcaaactcctggactcaagaactctgccctccttggcctcttaaagtgctgggattacaggcatgagccaccacacctggctgaaataattttttttttaactctttcctcacaactttttattttgaataatatcatgcctatggaaaagtagtaagaatggtatattgaacatctgtataatcttgcatagattcattaattgatactttgctttcttgctctctctttatatgtactttgaaaatttctgaactatttgaggattgcagatatcatgatcataacacttaacctaaatgtttcagcatgtaatcatgcatcttttggtaataaacacattcttctatgtagcatgatcacactcaggaaatttagcattgacacaataatattacctaaaactcagtctgtattccagatttctccaattgttcaagcaagtcccttatactttctaccctaaccccccgccaaatccatgattggatcaagagctacacattgcagtaggttgttttatctttttaaatctacaacgctcccccatccttttacatctactcctcacattttcgaagaatccaggcaaattgttttttagaatgttcctcaatttggatttgtctcattgttttagttttatttcatcactagattcaagttaaacatttttggcaagaacactatataaggtgttatgttctcagtatatgacatcagggtgtctatgataccagttttggtgatgttaaatttgattatttggttaaggtgggatatgacagatttctccattgtaaagatatcgtttcccctttgtaattaataagtaatttatggggtgatacttttggattatgtatcttgttacccaacaactctcacccagtgattttagcatttgttaagtcttgcctgaatcagttatagtaactgtaaaatggcatttttctatttctgttcttccttctatatttatcattagatattatttttaaaaagttattcctctccctcacttaaaaacattagcatcactctggacttatggatttttattcagagtattataatctattatttattttggaacttaagttgtttcatatttcctgataggagtttctttaaactgcctctctttttctttgactagtcctcagttagattttgagggcttacttccttacttaccagtacaagacatttagcctcaccttgtattttccttgccccagctctgaaatcagccttttttctccagagtcctaatttcttttagtgaggaatagtatatagtaggttaagtatattcagtgttattggagtattttgacttctaggttctagtggataattttttaaaaatgagattaaccaatgcctctaattctcatccagtactgcaaccatctctgatgccatatctgacctcttgtgtcctgtagccagactcctggttctcaacaatattaatatttattcatttgttcaatcctataatagacacaaaatagtttcagaatgttgcatcaagaccactgtcaacaacaaactttataaagttcggagttttttatatttcttttgatttatcttcagtgtattctgctgtggttagcaaactgtggcctgtgggtcaaatctgaccaccaccttttcagtatggcctgtgaactaagaatgctttttaagtttttaagttcttttaaaaaataaaaaatatttcatgacccatgaaaattacatgaaattcagacttcaatatctgaatttagaatacagccatactcattcgtttacatattgtttatggctgctttcatgctacataggtagaattaagtagttataccagagatcttaatggcctgtaaagcctgaaatattttctgcctggctccttactgaaaatgtttgtcaattttaatactattatatttaacaattactggaatgctttttttcctgcgtgattgtgttatatattattagattcatttatttactcaattttagggagaaaggaattttttttaaatgttggaaattggcagtgatcgaattttagaattagaaggatatttagtgttcctgtagtcccacactgtccagtaggataaccactagccaaatgtagccatttaaattaaatataaaaaattcttggctgggcgcggtggctcacgcctgtaatcctagcactttgggaggccaaagcgggcagatcacttgaggtcaggagttcaaaaccagcctggccaacatggtgaaaccccgtctctactaaaaatacaaaaaaattagccgggtgtggagacaggcgcctgtaatcccagatactcaggaggctgaggcaggagaattgcttgaacctgggaggcagaggttgcaacgagccgaggtcatgccactgcactctagcctgggcgacagagcgagactccgtctaaaaaacgaaaagaaaaaaaaattcttaagttatatgagtcacatttcaaatgtttagtcatcctatgtggcatggttcctatataggacagtacagattatagatcacaaaaagttctatcattttacagatgaggaagttgaggttcagaaaaatgaagtgactgctccaaggtaatagatagacagtaacagatttagagtgaatcagtggcttactagatattacagttgttgtgacatttgtaatagaaaagaaagacccctgtgttaggctatgaaacccccccacccccctttttttttttgagacgacctcactctgtcatccaggctggagatcagtggtatgatgatggctcactacagcctcaaccccccaggctcaagctatcctctcacctcagcctactgagtagctgagaccacaggcatgtaccactactcccggctaattaaaaaaaaaaatgtgtagagacaggatctccctatgttccccaggctggtcttcaactcctgggctcaagggatcctcctgccttggtattacaggtgtgagccaccacgcctggctgaaatccctttttttttttttactaaattccagatgagtgcatcatagtaacatcgaaatatttgtattttgagagcttaatgattggttgaaatgggtgccctgtttttgctgctttgcactcatttgcattcattcatttgagttcagttttcactcattcgtattcattcatttttgcagtaaggacgtttttccatttgtacattgatttaggaacataggaagctatcgggaaaggttagaaaaactggggtatgctaagtaaaacaacaacaaaactattgattctctgtccagctgtaatccttttcctgttaatgtcaccaacatacatgagcagggttattctctcatttgtgagcccttactgtaacaaaggtctcagtatatgtgattgtgacttcttttccccttgattttctggggcaagtgttgaggtggagattgcggaaataatatattgagtgcagtgaatcagattgaagattagcaaaccttacaaatagtaatgtgtctttttcagtgataccttcaattagtttaggtgcttctgtggttgactttgaaaataacaatcagaataatttcagcatgaagaaatagaaatcattatgatatggtggaaatctttgagattagacagatctggattcaagtactactctattacttttgcctgcgtaaccgtaggcaagccacttaatccttctgaggggattaacaaaaggaactgtcattgttttaagaataagtgacagaatgtgagatgtttaagttattgttgctgcataaccatgccaacatttagtagcataagttaatcaccattttattatttacaggatctctcagtgaggaattcaaacagggtacaggagtgagagctcttttctgttccacagtgtctgcttgctcattggcaatggctgggggttggaacacttggaggtgggggatccacttcgcagattgcttattcatatgtctaatgactgaaggatgggctcagctgggactgttgagcagagcacttatgtatggtttctctatatggcttgggcttcttaacagcatgttagaagctgggttctgaagggaagcatcctgagagtgagtgttccaagggagctagatagaagctaaagggcttttctgatgtagtcttagaagtcatatagcatcacatctactgtactctgttggtcaaagcaattacaagtctcaagcttcttcccccacccctccttccccagaatcaagagaggtgatgtagactccctttttttttttttttttttgagacagaatctcctgggctcaatcagtcttcctgccttaacctaccaccaagtagctggggctacaggtgcacaccaccatgcccacctaattttttttttttttttttttgagacagagtcttgctctgtcgcccaggctggagtgaagtggcgcaatcttggctcactgcaagctccgcctcccgggttcacgccattctcctgcctcagcctcccgagtagctgggactacaggcgcctgccaccatgcccggctaattttttgtattttttagtagagacagggtttcgctgtgttagccaggatggtctcgatctcctgaccttgtgatctgcccgccttggcctcccaaagtgctgggattacaggcatgagctactgcgcccagctgcccagctaattttttttttttttttttttttgtagagatggggttttgctgtattgcccagggtggtctcgaactcctgagctcaagcagtctgcccgcctcagcctaccaaagtgctaagattataggcgtgagccaccatgcctggtcagtcttctaactcttgaagggaggagtgtctggcattaaaagcagcataagtcaaagtttctagttttatcagtctgggttcctcatcctttccatttttcttctattcattttatgatactgaggaggaaaagaaacacctctaaacttcctcttatactgtttgttaacagtagattagagtttctcaactttagcactattgacattttggaccagatcattatttgtatgattgtcctgtgcaatccgtgatgtctaatggcgtccctggcgtctctgcactggagccagtagcactttacccttcaattgtgagaaccaaaaaatgtctgcatacattgccaagtgttccgtggaggacaaacttgcccctgtttgagaaccactgctctacattcgtgtttctcaaagatattgatatggaccagccacattgatatcacttgcgggacttactgaagtgttattttttcagaatctggaattgggtcccaaaaatctgtattttttaaaaactcctcaagtgattctgatgcacacttaagtgagagaaatgctgatataggttatccttaaaagctgaatgactaagaggtatataaatgctttactcactggtaatatactggtttcaggtcagattaatggcatagtagagttgttaaatatactgttatatattatatattattttgggttccatttccatagattattagtgtaaatagtatatccattcctgtttcatgaaatttttgttttttaattatttttctcagctttattgtgaaaactttcaaacacagaaaaattaaaagaatgatgcatataatgaacacttacatactttaccactgagaatcaagagctgttaaaattttgccgtgtttgctttgtgtgtgtgtgtctacgtgtgtgagagaatgagtgcacacgtgtgagcaatcagagctttcctggtgtatatgagagagagacagggagagagcaatcagaagttttcatggtatgtatgaaatccaagtaaaggagagagaggtgtaggattctgcagtataagtgctcccatgtggatagactgatccattcatcttcacggtatttaatcaggatacctttactctcaagcagagttgatttagtgtaatggattgcaaagttttaaaaatgcgtgcttggttgaacacctttctttccttactatttagtggttttaatgccactccagtcaaattacacttctcctcctttcatatagcctaggacagtgctactcaacagattgtctatggactgggtaccagtccctggcctatgaggaaataaatacagtaaatgagagtgagtatttagtattagtattttataacagttgagagatacttcaccttctgcttaataatgaaaaattatgactcgtattttttgtgtcttaaaaaattttattttctagtcacttttattgtatttgcaaacatactgtattggtctgtgttctagttacctactgctgtgtaaccatcccagaatgtaatgatttaaaacaataacagtaattaattttgttcatgagtctgtaatttgggcaggacttggcaaggaagacttttctcttttcattgcagtcagctgtagtggctcaactgaagttgctccactcacatatctggcagattggtgctggctctgagcagagattctgtcagtgctgagggctgaggatctcagttcctttctacatgtgacctgggcttccttggaggtgggtgactggattctggggataagtatccccagacaaacccagtaaaaattgtatctccttttgtgaccaagcctcagaagtcactgcgtcatttctgctatcctcttattcactgaggcagctactaaggtctacccacattaatggtggaagggacatagactccacctcttggtgtagtggcaaaattgtagaaaattgttgctgtcatttttgttaaaatacaatctgccatagcctgtgatagattaaaaatggaagaaactggcccttccccacagatacaacctgagaggcaccactgacctggtcctacctggctttaggttgggcacttactataatacagttctaatttaactactatacatttggaagacaccttattatacctttatgcagtagacgtaatatgggacaatggtgggagagataacaaaaggctaataggaaactcgtgaatgggtgtgtaggtgtgtgtgggtgcacacgtgtgcatgtgtgtgcatggtggttctgtttttggcttacaggttttagcatttacaaatcttctcctgggctggtggctagttttctcaaagggattaccagtatcctgcctgggcaataaacctggctgctagtgttccagaaacccagttggggaaggacattgagggaaacagaggccaaagtgatactgatgtttctatataatacatactttttgaatactgctgagtacagagctcagtactaggtgctaagagaaatacaaaggtaaagctccttttatttgacactttaatgtttaagtagtattcttattaatattcaagatctatacattatgattactactaatagtgatactgctattagaagtagtattgtctaacactttatgtatgtaatacttcaaagattccaaactggttttcagatattttctactgccttagctaatagattagctctagtaagtcgtcagtacttactgtagtacctggaacagagtggatgcttaatacatattttattaaataaataaatgaatctttaaggtatggtagaatgattgcagcctctggtgtctggctcattaggtcttgtactttctagcagtgtggcaatgaggggattgtggaacctatgtagttctatttcttcatctatagaaataaagttaatctctctttacacactatatataaaaattggttgaaagcatcaggtatgagtccctaagttggtgtgtatgttttccacttctagttttaaagcccagtatgtgtggtgagtagaagaaattgctggtattaaagactagtattagacattttaggcactgaagtttaaaaatagaatgttgcccctaggagtagggcagtgcattattaaattaagtgttgaaatctttatgcctcttcatgcaacataaacttttatttggaataaatatgacatattaaacaaaattaaagtttattttggtttatttaaaaatttacccttgttacagtagttttattgatgtgttcgtaagaaaacttagggttttctttttctccccagattaacttgttgtttgcaaattttgacagggcttttgaaaataggtaatgtatttttaaaaagatgatggaggaagaaatccaattgagtgtatttatttagaataagagagatcacaaattaagagatgctaataccacaaatttcacaaaattcaaaaataaaataatttcactaattaactgcctgacacacctctaaacatttgattacagaaacttagatcacttcataaaatgttatgttttaaaaaattgtttttaatcgaggtaaaatatgaatagcataaaatttactaaaatttaccatcttaaccatttttaagtgtacagttcagtagtagtaggtacattcacattcctgtggagccatcaccaccatccatcttcagaatgcttttcatctttaaagtatgaaattctgtacccaataaacatctctccattccccattctactttttgtctgtgattttgaacgtactaggttcctcatataatggaattatatataatatttgtcattttgttgactggcgtatttgacttagcataatgtctcaaggttcatctgcattgtagcatgtgtcagaattgcctacctatttaaaggctcaataacacttcattgtgtggatataccatattttgcttatctcctcaatggacacttggtttgttttcatcttttggttattgtgaataatgctgttgtgaacgtgtgtacaaatatctctttgggacccagctttcagttattttgggtatataagcagaagtgaaattgctgaatcataggataattctatttttcattttttgaggaacaactctactgttttccacagtgggtgcaccatttacactcccaccaacagtgtacttccagtttctccttatccttgccaacacttgttatttttcttttttctttttttttttttaaagtagtaaccatctaaataagtgtgaggtgggtatttcattgtggttttaatatgcgttttcctaatgattagtgatattgagcatcttttcatgtgtatattggccacttgtatatcttctttggagaaatgcctattgacgttctttgtcctttttaaattggattgtttggtttttggttgagttatagaagttatttatatattccagacattaggttcatctgatacatgattggcaaatatttccttctctattgtgtttttaaaaatcgctttcttgatggtgtcctttgacagacaaatagttttaattttgatgaagtccaatttatctgtttttttcttttgttgcccgtgctattggtgtcatataaagaaattattgccaaatccagtgccatgaagctctattcctatattttcttctaagagttgtgtatgcaggggtttatttctacatcccatctattttgatgtgttgttatttttgttttcatttatccatctcagaggattttctgatttctcttgtgttttactttgaccattacttatgaatgcgttatttttcactttcttgtaaattttcctaatttcctgttaataattgataatttcttctttattattttttgagacagaatctcactcactcaggctggagtgcagtggtgtgatctcggctcagtgcaacctctgcctcccaggttcaagtgattctcctgcctcagcctcctgagtagctgggattacaggtgcataccaccatgctcagctaattttttttttgtatttttagtagagactcggtttcattatgttggccaggctagtcttgaactcctgacctcaagtgatcctcctgcctcggcctttcaaagtgctgggattacaggtgtgagccactgcacctggccacctgttactcatttctaattttattccattgtggttgaataacatactttgcatgatttcagtccttttaaatttactgatgattttttatggccctaatatatattattctactttggagaatgtaccatgtgcacttgaatagattctatatattttttttgttggtcatagtgttctataaatgtctgttagatctagttggtttataatgttgttcaaatgttctgtttatttttctgcatattttattcattattgagaatgaagtattgaagtctcctactattgtcaaattgtctatttctcccttcaattctgtcagttcttgctagatgtattttgggacgttgtttttagctgcatatatgtttataattgtctgcccttttgttcttatacaataagagtaaaacttattatctagtagcacttttggataaatatctcattttgactgaaattagtattagtataggtatggtagctctgttgttacttttttggggtatatatttatatatatttttatattgtttatgttttagaatctgaaatatggcttttgtagagagcatataattggagcagggttttaaaaatccattctgctcatctctgccttttgatttgagtatttagtccatttacacttaatgaaattactgacaaaccagcaccattttgcaaatgttttatatgtctttggtcccttttgtttctctattcatctattattgtttgtttgttgttgtatgttgatatttttaaatttgtcattttatttctattgtttatttcactgtatcttttcaagaaaattttttctttgtgattgcccagggtatttacttataactatctcatggggggaactgcaacttaattcagtagtattcagaaattttgctcctatatagcacatcctcctttccccttcctttgtattactgtcacacaaattgcatctttatacattgtaagcccatcaacgttgtattgctttacgcagttatattttaaatcagataggaggaaaaaagagttacaaacacaaaatgtatttctaccgttgtttacatttagctatctaattactctttttttttttttttttttgagacagagtcttgctgtgtcgtctgggttggagtgcagtggcacaatctcagctcattgcaacttctgcctcctgggttcaagcgattctcctgcctcagcctcccgagtagctgggactacaggcatgtgccactatgcccagctactttttgtatttttagtagagatggggtttcaccatgttggttggccaggatggtctcaatctcttgaccttgtgatctacccaccttggcctcccaaagtgctgggattacaggcctaagccacctagcttaggctatctaattactcttaactggtactttttattataggacagattgctagtgacaaattcttttaggttttgtttctctgggaatatttaaaattattcctcattttctaaagctttgttttgctacatatggtattctttttgatagccatttcctattaatactttgaatgtatcatcctactaccttctaaccttcatgtttctggactagatattgccttgtactgtaattgaggatcatttgtaagtgatgagttactttctttttgcgctggagattttctttctctttgatttttgaccacttgactatggtatgtttaggtataaatctctttgagtttatcctaattggaggtcattaagtttcttggatgtgtagattaatttttctaagtcaaatttgaggaggtaggtgccattatttcttcaagtattctgtcagcccccttttctgtctactatctttctcggacttttattgtgactgtattggtatgcttgttagtgtctttgaggtctcaggctctgttcgtgtttttttgttttgttttgttttgttttcagtctattctttctgttcttgagactggatattctcagttaacttgttttcaagttgactgattcttctgtctgttcgaatctgctgttgcgctcttctattaacagtggtagaaagttcgatttatgattatggaaattgagatgtcatttttaaactgtccttttatttcaaaaggatttttaaattgaaaacattataaagtgctttcttttatatttgagctagaatgtatagaaccacttatataaattattttttagggtaaattgatcacttaaagattagtcattttgtgttttagcttagtgcagtacctatatttcctggtacctacaatagccctttgagttgggtgctattattatttgtccatttcagtgaagcaagtgaggcagagagaggctaactagaataaacacacaactggttatcactgttcttttcttattaacaggttttatggctataatctatagaacaatgcatagctgaattgttacaacgtctgaggttaaaagccaatattaaaatttttaatttgcacttatatttaccatcactgaaagaaataagctacattttattaacataatgaagaaaaattaccaaagtatgaattttgccaagttaaactaatcttgatgataaccaggagattgtgaaccagaatatctatcggggaaccagcccccaatatttcaacgtaggttcttttctattttccctaagtgtcagccggtctgagaaataaagggaaagagtacaaaagagagagattttaaagctgggtgtctgggggagacatcacatgtcagtaggttctgtgatgccccctgagctgcaaaaccagcaagtttttattagcgattttcaaaggggagggagtgtatgaatagggtgtgggtcacagagatcacatgcttcaaaggcaataaagtatcacgaggcaaatgggcagggcaaggtcacaaggccagggtgaaactgggattgctgatgaagtttcatgtcccactgtgtgcgcattgtcattgataaacatcttaacaggaaacagggttcaagagtggagaactggtctgactagaattcaccaggctggaatttcctaatcctagcaagcctggggacgctgcaggagaccagggcgtgtttcatccttacctacaactgcataaggcagacgctcccagagcggccattttagaggcctccccctgggaatgcattctttccccagggctgtcaattattaatattccttactggggaaagaattcagcgatgtttctcttacccgttttcagcaataagagaaatatgactctgtcctgcccggctcccaggcagttagacctaatggttatctcccttgtcccctgaacatcgctgttatcctgttcttttttcaatgtgctgagatttcatattgttcaaacacacatgctttacgaacaatttgtgtagttaatgcaatcatcacaggctcctgaggtgacacatacatcctcagcttacaaagatgatgggattaagagattaaagtaaagacagacataggaaattataaaagtattgattggggaagtgataaatgtccgtgaagtcatcacagtttatgtttagagattgtattaaagtcgggcgtaagaaattataaaagtattaatttggggaactaataaatgtccatgaaatcttcacaatttgtgttcttctgccatggcttcagcaggtccctctgttcggggtccctgacttcctgcaacaaatgtcaaaaatccatgtatattttgcttcttaggtggtttgaccatatagtttgtttatttgtttcatttttagtttttttttttttttttttttttttttttggtgatagtctcactcttcacccaggttggagtgcagtggcttaatcatagctcacagcagcctcgaactcctgggttcaagtgatcctcctatctcaactgggattacaggtgcgtgccaccatgcctagctaatttttgttttttgtttttgtagagatggggttttgccatattgtccaggctggtcttgaactcctgggctcaagctatctgcccacctcagcctcccaaagtgctggtattataggtttgagtcgctgcacctggccagatttttttttaacagctttgttgaggtaaagtagcatataataagtgacatatgtttagagtatagtacttgatgtttttgttataggatccgtgggatattgcttagccagctggaaacctctgtggccagtggcgcctttgcctgagttttgttctggcctgctgggcttgttccatccacttggcatggcaggctgtacttggctcccgctaccagcctggatcccacacctgccaagggtgagccagatgtggagcagcaaggcgtgtgtggagctggggtccagccactgtgcacagccaggcatgctggctgttgcagggtatgcagctccaggtgtcggcatgggtgctggctctgtgcaaggctgttgctggatcaagcataccataagcagcttccacggctgacgctggggaatgcggtgtggcacctggaagcttggagatgccagaaatcacggagccttgaagagggtgtcagagccctggcttggagagtttctaggtctgggctccctgaagggctgcagcatttctctcctcctctcttctgtccttcttgtcacctgcagcaacgtggtgggcaagaggtgtgtttcagccctgtttgtgttacagctcttttaagcctgccattcagcgggtcctgagttcttgtcctgtgtccaggaagaatgaggtatgcagacaagtggagagtaagcaagacaaagaggagctttattgagcgacagagcagctcagaggagacctgcagtgggcagctcctctctgtagtcagagtgtccagatgagtgttcagctctcagcagaaagggtagctccactctgcagctggctatcccattgtttcttcagctctcagcggagagggtagttcttcttggctgctggttgtcctgttgtctcctcagctctgagcagagaggagaccctgaggtgggcaggtcctctctgcagttggttgtcccatcatctcttggtgtctggctgagtctggggatttatgggcctcagagggaagtgcttgctgcttggtccatgggtggccatggacggactggaaaaggcaccacaagttcccactctggtccatgggaccagcagcccagcccccaggcttcaggctctctgtggcttgaaggtggggctttaccggggacctggctggcctcttccacccaggagcctgactcctgccaccgttcatggtgcccaggctatttgtgccaaggggcgcctgcaggccagtgctaagcgggcctcaccccctcctcggcctttctcctgtgctcgttggcacccaaagtccagagggggccaaggtggcagggggctggcatgtcagtactgcttctggtgtgtgcatacctggctgggttgtgacagcacccgggcttggcctcaacttggctccacagtcggagctggcgttgacaacagggagaggccaggcagtgggagcagacacctctgagcctgtgagggcaagggggggccttcctgggtcccccaagattgcagagatgcctgggtccacaactgtaacttttgcagcaacatccatgcctggggggcggggcttctgcctgctcctggcttccaccagctctgtggagcaaggcaccgccctgggcccagttctgccttggggccctctatccccacccctttgtgcctaacatcactgctccctcactggtgggtgacttgcccggccccatcgcaatggctcaggagcgaggggaggcatgggggcaaggtgcaggtggcactgcagccaggcaaaccctgcagaaatgaaccctacacttggggccagccttgcgaatcctgactgcaccttctttggggtgcctgcgggcccctgagatgcagtggggagcatgattgccgaggcttcgggcctggaaatgggtcctacccggccatgcgagggcaggggtggcccagaggctgcctcagggatgcaggacacaagggacccactgctgctcccacagctgctcctgctgccactgctctggcctccccactgcagctggcgtgatggcagtggctgttctggatggcccgctgctgccaccatcattttgacatatgtatacatccattaaaccaccactacaataaaaataatgaacatatctattactcctgaaagtttttttgtgccttgatgtaatcccttctcccacagctcccccactggactctcatccccagggaactgctggtctgctgtctatcaccatagctttgtttgtgttttgtagaattttatataaatggaatcatacagtatatactctttttttggtctaatttgtttctcattgtaattatttttagacttgtctatgttgttgcatgtatgaatagttctgttttattacttgtattccattttattgatatactacaggtcaattaatatcacatatgaataaactaattcacctattagatgcttgtttccagtttggggatataataaaacattcatatacagatctttatatggatctatgcatttgttacctaggaacgcaatggacagctcataaagcaggaatatgttcaattttgtaagaaagtgccaaaccgttttccagcattgttgtaacattttatattcccaccagtgatgaatgagagatgtattttctctagatcatttccagcatttggcattgtcactgtttttgtgtgtgtgtgtgtgtgtgtgtgtgtgtgtgtgtgttttgccattctgataggtaggtagtgatatcgcatggttttaaattgcctgagcctaatgtctcatgatgttgagcatctttttgtatggttatttgccatccatatatcttctttggtgaagtatttgttcacatctttcgccttgtttttttaattgtttttttctttttatttagttttgagagttctttatattttggatacaagtcctatgtgcttttgcaaattttttcccagcctctgggttgtcttttcattctcttaacagtgccttttgaacagcagatagtttaattttgatgatgtcgaaagagtgatgaagaaaagattagccactctccactgaattccctttttacctttgtcaaagttacgttgtccatatatatgggggtattattctggactgttttgttccattgatgtgttgtcttatcttgatgcctgtatgacagtgtcttggttttgctagctttatagtaagtcttgaaatcaggtagatatactcccctatggtgaccatctttttcagagttgctttagaagtggtaaaagtagatggacatctttgttttgttcctgatattagatgaaaagtgctcaattttttgccattaagtgcgatgttgaatatgttttctgtagatgtcctttatcaggtcaagaagatccagctgatctctttcctccattctctgccaccttcagtccatctttcttgtgctttcttgctgctgctgcatatggtcatgtcatttgtcttctatggcctaaatcctttaatctctatttatggcaatagaaaaaataaactaagtttttgccatttgacctttgaggttaaaacaaggtcggaaacagcatgcatatttttattaaacaaaatagattatattaacgttaacagaattttaaatatgaaaaaattgtatcccagaattttaattccccagtcatggtgtgcatttgcctaagcgcttcttctttttttgtatttgttcatatcttttatagttcgaacatcatttatgttcaactcttcacttaacataatgtatataactttttacatattttttgaacataaaaagtagatttatcttggttttcaaacttttagaatatttacaattttataggtacattaaatatgtttaaaggaataaacatttttatagattattatttataatccttttttaaaagaaatgggctctttcctactgtcagcagctgtttatacatatataccaattttactgcaacatctttttttttttttttgagacggagttttgcgcttgtcacccaggctggagtgcaatggcatgatctcagcttactgcaacctccgccttccaggttcaagcgattttcctgcctcagcctaccgggtagctgggatgacaggcacccgccaccatgcctggctaatttttgtatttttagtagagacagggtttcaccatgttggccaggctggtcttgaactctggacctcaggtgatcctcccaccttggcctcccaaagtgttgggattacaggcatgagccaccatgcgcggccaactgcaacacctttcaaatggaaaagtaaagatgtgatagataattttatttgatcttctttccccttttaaaacatgaagatttagcatattttttcccaaagagagaattttcaagtagtgaattctccagaaattaagaattactgtattgtgaaatgaaaagtaaatgtggcaggaagtgggaatatatttgataccttggtaactaaaaatattgtgttagtttatggaaaaatcaagagctgattagacaattcacttaagctttaggtctatatttatttggatagattaataccatattcaggtaggttctccaaatatactgttttattaactattgtttattcattttcaaagactcagcttatagtgtcagactaatttattcacagccgtaactagtggagtatgaggcagaaaagcaggctgggaggagtgctgattttcaggacctgaagggtggaaaatatactgttgatatatcgttatgattgctttatcgaatgtattgtttgatggctactcctcggcttctctctgatccagtaataaaccttataaaacccaggagataaccaaaatgtagctctatacaatcatctttcatagttgttatggcaggtgaagttgttagggacatttgaatgttatttttcggcttcagatcattggaaactaggatgacttaatgttcctctattggtctgtagagattgtagtagcaaagttcaaactactgatactaatttttgtcacagctatttttaacctccataagtgaaatgctgaaaagttataaagcaggaacagtgattatttcaatgatgactgcttcttagtattggaaatattttattgacaaactatccaatccaaagttatcaaacaaattagtagaacatttgaaaaataaaaaacacttcagttaatgataacccttgttaagaatcaatagaaataagacatgtgagtaatggcaaatttttcgttttaaagttggccatttaaaagggaaatactagacatggtaatttggttattatactttaggttgggagtatgaagaattacctttgtatctggctataagtctgccacctctcagcaaatttgaaataattgagcttacagattctcacctttctaagaagtttgcctaatttaggcacttttttcaccccagaattcactcttcttggaactgaaagaatatggtggggtttataattccaaaacatttcccctggaaacacaggaaacggaaaagaaggaaaagacgttaaagctgactaggtgggttagcttcaagtgctggttctcttttcctgtgtcttcacttcataaaatcaggagttgatcatgcttttaatgtaattattttctggtcaagaaaaataccatatagaaaactttagactcctccagtgatgtagtttgcaaaataaaaatgcgttctttgaccattatgaaagtaattttatacagatttttcttcattttcttaagttacatatagaagataaaatagaaaaaaattgtgagtcgatacattctttttgggtaaaagggagataataccttattaaaggaaaaatgcgtaatgacttcattcctccagattgctttaaagagccttttgttctcatatgttcttttaattctaagaggatgcaatcattatttttaacattcctctacctcccacttgtagtaagatatttgaattgtatgtatttgtttcaggattttgtcagagatccagtttctcagcatctttaccaaaatgccactattttttattttggccgttaaataggtatatggtggtatctcataatggtcttaatttacatttcccaaatggctcagattgagcatcctttcatgtgcttaatggccatctgaatatcccattcggtaaaatgtctttttatgtttttttgcccattttctaatgggattatttgatttttttttttttttactgttgagttctgagagtttattacatattctgagtactagtctattgtcagataaatgttttgcaggcttttttttttttacagtctgtaagttttaaattttgatgatatagctaatttgtcttttttgttgttgtttttatgaatcatgcttttgatgtcacatctaagaacacttcaccatacctaggtccctaagattttctagtatgttttcttctaaaagttagtgttttaggttttacatttaaatctgagtcagtgagtaattttttgcataaggtgtgaggtttaggttgaggttcatttttcattttgtgtatggatttctgattggttcagcactgtttgttgaaaaggccatcctttctctgttgaattgtttttgtacctttgttaaaaatcagttggctgtacttgtgtggtaattctattttgttccagtgatctcggtgtctctacttctgtcgttaccaacagtcttgataaatgtaggtacataatcataaaatctgggagagggattcccagtttatttttctttgggagtgggagtatagttactcccactttagtctttttcaaaattgtttttgctacaatgattcctttgcctttccatattaattttttattttttttaaatttgaggcagagcctcgctctatcacccaagctggagtgcagtggcacgatcttggttcactgaagctccgcctcctgggttcaagtgattctcctgccttagcctactgagtagctgggattacaaacatgcatcaccacgcctggctaatttttctatttttagtagagatggggtttcgccaagttggccaggctggtcttgagctcctggcctcaagtgttctgcctgcctaggcctcccaaaattctgggattacaggcgtgagtcactgcgcctggccttccatattaattttagaataaaattatctaaaataaaattatctacaaaaaagtactgggattttgatagaaattacattaaacctgtatgcctatttggagagaattgacgtgtttactagtttgaatgttccagtccgtgaacatagttatgtctctccatttatttagattttcttcaatttttttatcagcattttgtagtttttagcatagaagttctctatgtgttttgttagatttacacctaagtattttgttttttgtttagcagttgcaaattatactgtattttgtttgactcctcatatttattcctagcatacacaaataaaactgatttttgtatgttgatgtattgggtgacctcgctgaacttacttattagttctaggagtgcttttgtagattccttgggattttctttgtaaaattatttcatctgcaaaaatgtttaatttattcctgtatgctatttctttctttttctgttttttctttctttctttccgttttttttttttttttttttgaggcagtcttattctctcacccaggctggagtgcagtggcgcaatcttggctcactgcaacctccgcctcctgggttcaagcgattctccttcctcagtctcccaagtagctgggactacaacaggcgcccgccaccacacccagctaattttttgtatttttaggagagacggggtttcaccctgttagccaggatggtctcgatctcttgaccttgtaatccgcctgccttagcctcccaaagtgctgggattaccggccaccgtgcccggcgctcctcctttttttaacctcacagcataggctaggacttgcagcattatgttgcatatgagtggtgagagcagatacccttccttgccttattcctggttataggggaaagcattcaggctttaaccattaagtatgatgttagctgtggatttttttgtagatgctttttattatgttgaagaagatccctttatttctagttttctaagaattttttattatgaatgggtggtgaattttgtcaaatgctttcctgcattgattaaaaaggtcatgtgatttttctcccttagtctgttaataaggtggattatattgattgattgttaaaatattgggtgaaccttgttgcacctttgaaataaaacccccttggtacatggtatgtaattctttttacatattgctgaattctggtttcttgtattttattaagggtttttgtgtctgtattcatgaggaatattggtttgtagttttctttatgtttttgtctgttttttccatcaggataaaattggctacatggaatgatttgagaagtatccttttctattctgctttctggaagagatcatctagaaattgtgttactttttctttaaatgttaggtagattttcccaggaaaccctctgtgtttgaatattctgttgggggagttttagaattacgaatttgatttttaaaatagttatagggctgtttaaattttctgtttcatattggctgaattttggcagtttgtgcctttcatggaattggttctttttatgtcaaattgatgtataagttgtttgtagtattaccatttcaatggttgcaaagtctatgtggtatcctctgtttcattcctaatgttagcaatttgtgttttctgtttctttgttagccttgctagaggtttattatgtttattgatcctttaaagaactagcttttttcccctattgattttctctatttttattttctttaatttcattgatttatgttctttgttatttccttccttctgtttgctatgagttcatttagctcattgtctaggttcttgaggagggaggttagattactgatttgagacatttcctgttttctattgtatgcatatattgctgtagatttctgtcagcactgcttaaatcatatctcacaaattttgatatgttgtgttttcatttttattcaatcagtgtatcttgattttccttaagatttcctctttgtccagtggataacgtagacttgtttagtttctacgtgtttggagatttttctgttgtctttctgttgttgatttctggtttgattccattgttctcagaatacattttgcataatttcaattatttaaatatttagatttgtttcttagcccaggatatggtctctcttgaaatgttcagtggatgtttaaaaataattaatattctgttgtctttgctagagtgttctataaatgttcatgattagatcctattggttgttaagttctcttatattcttgctaattttcctagttgtatcaattattgagaaaggggagttgagctctcctataattgtgggatttatctttttttatttcagtttgacagttttgcttcatgtatttttgcagctctgttggttggtacatccacatttaggattggtaatgtctcggtggcttgaccattttatcattatgtaatgcctaatctgttcttatgaattttatttgttcccaagtctactttatctgatactaatataggtactcttcttcctattgattaatgtttccatgatacatctctttccatccttgtactttctacctgcctgtattgttatatgtgaggagagtttctggaagacagcattatagctgggccatgtaccccatccccacccccactccgccaatcactgtcattttagtttcttagagacagggtttctgtctgtctctgacactggggtacagtggcatgatcatagctcactgtaaccttgaactcctgggctcaagggatcctcctacctcagcctcctgagtagctaggactacaggtgcatgccaccatgctcagctaattttttttttttaattatactttaagttctagggtacatgtgcacaacgtgcaagtttgttacataggtatacatgtgccatgtttgtttgctgcacccattaactcatcatttacattaggtatttctcctaataccatccctctccctgccctccacccaacgacaggcccccgtgtgtgatgttccccgccctgtgtccaagtgttctcattgttcatttcccacctgtgagtgagaacatgcagtgttttgttttctctccttgcgatagtttgctcagaatgatgatttccagtttcatccatgtccctgcaaaggacgtgaactcatccttttttatggctgcatagtattccatggtgtatatgtgccacattttcttaatctagtctatcatagatgaacatttgggttggttccaagtttttgctattgtgaatagtgctgcaacaaacatacacgtgtatgtgtctttatagcagaatgatttataatcctttgggcatatacccagtaatgggatctttgggtcaaatggtatttctagttctagatccttgaggaatcatcatactgtcttccacaatggttgaactagtttacactcccaccaacagtgtaaaagtgttctatttctccacatcctctccagcatctgttgtttcctgactttttaatgatcgccattctaactggcatgagatggtatctcattgtggttttgatttgcattctggtcatctctgatgaccagtgatgatgagcattttttcatgtgtctgttggctgcataaatgtctttttttgagaagtgtctgttcatatcctttgcccactttttgatggggttgtttgtttttttcttataaatttgtttaagttctttgtagattctggatattagcccttcgtagatggatagattgcaaaaattttctcctgttttgtatgttgcctgttcactctgatggtagtttcttttgctgtgcagaagttctttagtttaatcagatctcatttgtctattttgttttgtttgtttttgccattgcttttggtgttttagttatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggccatttcttgtttttgtcaggtttgtcaaagatcagatggttgtagatgtgtggtgatatttctgaggcctctgttctgttccattggtctatctctctgttctgataccagtaccatgctgttttggttactgtagccttgtagtatagtttgaagtcagatagtgtgatgcctccagctttgttctttttgcttaggattgtcttggcaacgtgggctcttttttggttctatatgaacttcaaagtagttttttccagttctgcaaagaaaatcattgttagcttgatggggatggcattgaatctataaattaccttgggcagtatggccattttcacgatactccttcttcctatccatgagcatggaatgttcttccatttgtttgtgtcctcttttaccccagaatttcatattcagccaaactaagcttcataagtgaaggagaaataaaattctttacagacaagcaaatgctgagagattttgtcaccaccaggcctggcttacaagagctcccgaaggaagcactaaacatggaaaggaacaactggtacccgccactgtaaaaacatgccaaattgtaaagaccatcgatgctaggaagaaactgcatcaactaatgggcaaaataaccagctaacatcataacgatgggatcaaattcacatataacaatattaaccttaaatgtaaattggctaaatgccccaattaaaagacagactagcaaattggataaagagtcaagacccatcagtgtgctgtattcaggagacccatctcacgtgcagagacacacataggctcaaaataaagggatggaggaatatctaacaagcaaatggaaagcaaaaaaaagcaggggttgcaatcccagtctctgataaaacagagtttaaaccaataaagatcaaaagagacaaagacggccattacataatggtaaagggatcaattcaacaagaagagctaactatcctaaatatatatgcacccaatacaggagcaccgagattcataaaacaagtccttagagacctgcaaagagacttagactcccacacaataataatggaagactttaacaccctactgtcaacattagacagatcagcgaggcagaaggttagaaagaatatccaggattgaactcagcgctgcaccaagcggacctaatagacatctacagaactctccaccccaaatcagcagaatatacattcttctcagcaccacatcacacaccacatccaaaattgaccacatagttggaagtaaagcactcctcagcaaatgtaaaagaacagaaatcacaacaaactgtctctcagaccacaatgcaatcaaattagaactcaggattaagaaactcacacaaaaccacacaactacatggaaactgaacaacctgcttctgaatgactacggggtaaataacaaaattaaggtagaaataaagatgttatttgaaaccaatgagaacaaagacacaacgtaccagaatctctgggacaacttaaagcagtgcgtagaggaaaatttatagcactaaatgcccacaagagaaagcaggaaagatctaaaatcgacaccctaacattacaatgaaaagaactagagaagcaagagcaaacacattcaaaagctagcagaaggcaagaaataactaagatcagagcagaactgaaggagatagagacgcaaaaaacccttcaaaaaatcaatgaatccagaagctggttttttgaaaagatcaacaaattgatagactgctagccagactaataaagaagaaaagagggaagaatcgaatagacgcaataaaaaatcataaaggagatatcaccacccatcccacagaaatacaaactaccatcagagtactataaacacctctacgcaaataaactagaaaatctagaagaaatggataaattcctgggcacatacaccctcccaagactaaaccaggaagaagttgaatctctgaatagaccaataacaggctctgaaattcaggcaataattaatagcctaccgaccaaaaaaagtccaggaccagacggattcatagccgaattctacaagagttacaaagcggagctcgtaccattccttctgaaactattccaatcaatagaaaaagagagaatcctccctaactcattttatgaggccagcatcatcctgataccaaagcctggcagagacacaacaaaaaaagagaattttagaccaatatccctgatgaacatcgatgcaaaaatcctcaataaaatactggcaaactgaatctaggagcatatcagaaagcttatcccccaagatcaagtcggcttcatccctgggatgcaaggctggttcagcatacacaaatcaataaacgtaatccatcagctaaacagaagcaatgacaaaaaccacatgattatctcaatagatgcagaaaaggcctttgacaaaattcaacagcctttcatgctaaaaactttcaataaactaggtattgatggaacgtatctcaaaataataagagctatttatgacaaacccacagccaatatcatactgaatgggcaaaagctggaagcatttcctttgaaaactggcacaagacagggatgccctctctcaaccactcctattcaacatagtgttggaagttctggccagggcagtcaggcaagagaaagaaataaagggtattcagttaggaaaagaggaagtcaaattgtccctgtttgcagatgacatgattgtatatatagaaaaccccatcatctcagcccaaaatctccttaagctgataagcaacttcagcaaagtcccaggatacaaaatcaatgtgcaaaaatcacaagcattcctatacaccaataacagacagagagccaaatcatgagtgaactcccattcacaattgctacaaagagaataaaatacctaggaatccaacttacaagggatgtgaaggacctgttcaaggagaactacaaaccactgctcaacgatgtaaaagaggcccagctaatttttaaaacattcttttttgtagaaacagggcctccctgtgttttccaggctggtctcaaactcttgtcctgaagcaatcctcccacctcccaaatcgttgggattacagtcatgagccacttcacccagcccaatcactgtcttttaattgtggaattttacttggcaagcgtctccttgtcaacatagtaagacttttttcccctacattatttttatatttatataacaatgacttttactttgagctttaatcttttgaaatgaataatctgtgagagatcagctccaggtattatcactgatttgaaatactattttcattatattttgcttactcattgttcatactgcttactacttattgcttactcattcaaacatcccaaatactagtctttcttctagtttagtgtgtttcctttacctaattgtctttaagacagaagtgttaggtgttttaaagtttgaatccttaaatgcctgagtgttttaagagtttttttttctcctccatgaatgttaattttctaggtatataagtcagtgtttcaaagaattttctttcacaactttgaagctacagcttcattgtctttaaacatctagtatcgctgatatcactgtgatttctgttgttttataggccatctagtttttatctcttaggttaaaaattcagaagcaaagattggtcaccatttctattttgttttcttaggaataataacaataatactattaggttgaattttgaggatggttaaaatgaagggttgtttttttttttaaacttcttggtttccccaacaccttaagttttttaaaaaagggaagggcctgccaaaattaaataatttttcctcctgttgtcattctacagtgctttaaaatacttgcatcaatgagtaatatccaacttcctgaggcagcataatcttcccgccccttttggctactccaaagtttacatattttgaattggaatatgacttccttaaaaatttatgtattaaatcttctggatggagcagttaaaaaaaaaacctctttttcaaagcagtggtaactttagtttgatgatgaactatatataacttatacctacaattcttattctggtgtttcaaaatttataactgttttccacctaagttttaattgagaaatatataataactttgccttttaaactacagcttatattttacgaaccttttatttagtgaatttttttttttttaacttagactttgtgtggacagtaatgacctcacgtttccgattgcctgctggcagaacctacaatgtacgagcatcagagttggcccgagacagacagcatactgaagtggtttgcaacatccttcttctggataacactgtacaagctttcaaagtcaatgtaagtattttgtgtcttttaaaaaataatctctggctataagtctgaatttagacatatatgtaaactaggattattaaattatagtacagtttgaaaagtcttattcaagtaaaaaagtctttttggtgcaggattgtattagatgcatgctctcattcaaactgggtctttttaaaaagtgttgctcactggatgttgttgagaaaccaacagtgtgcattttgattagtagagcagatccatagtatgtgtgtggttttcataaatgtgcttgagggtgcctgaaaagaatttgttcttctaaataatttatacatattcatggtaattttacttgtactgtctgtgagtaaaatttttgccaaacaaaaataaatgacagccctgatcttatctatcgtctgaaatatttatttaacaaatatttgttcatcctatttgtgtctagctttgtttgctcatcgttatttgtgagttttacccatgtggtgtgttaacagtagttagttcattgttactgctctgtagtacccttttgtatgaatatactatagtttacttatcctttcatttaccatttacttgtccagtttattgttggtatatatttggatttgtttccactttgggctcttacaaataatactgctgtgaacattcttgtacatatcttgatacatataaaagtgtattctccctttttatttaaaaacttttcaacctatatggaaaaggtgaaataatattataatgaatacccttataccctttacctaaattgacccagtgttaacattttgcacatttactttatgtttccttctctctacatgacttttttttcctgaaccttttgaaagtaagtacttcagtattccgagaatctcataattaccacatccctaaatttaactttatgaaaataataatatatgcagtctgtattcaaactggaattcttattcttcaggatgttttggtatttccaaatttttcaggatgttttctgctgtattacttgggtatttccacactttgaaatctttaagtaatataaaatatgaatcttacaccggggccagtcgggggattaggggctgggggagggatagcattaggagaaatacccaatgtaaatgatgagttgatgggtgcagccaaccaacatggcacatgtatacctaggtatcaaacctgcatgttgtgcacatgtaccctagaacttaaagtataataatacaaaaaatgaatctttcttatttaccagtttaagcttaaaattttctgtgtattactatatagcaggattatgaatttatctcaaattccaagctatttcacattgaaaaaggggctgcagagtagtgaatattacatcattatcattaaaaataccttcaacattatctaaaatacccaacagatttaggatttagtgtgcttttctaaaaagctaaacttttgatttcttttgtattctatcatctgttaatatatagttggaatataggttgccaaacagagataacataaagtgaagagaattctacttcgtacaaatttctatttaatagaaactctcatgtattagacagttgatgtaagaaaataagccttttttcctattattcacgtgttagaattcttttttggaaaaggcataaatttaataacttttgtcttagcttaaatttagctactatttagttttcattttaactatagttttgaatgtatttcaaaatattgtaaaaaggtttggtatgtttctcagctagcataattttctgttgagcactttagttaacagtagtatgctgtatttttcagtgtagtaatcaatgtgctgtctagttactcttttagaaagacatatatattaatgtacttttatatgtttatattttaaaaatatatattacatatatttagctggcagtttcaatagacctggatatattacctagaatggtaagtaagcttaccattctgtggtgctagaaactttctctaccattatctcaggtcatcaaaaaacttaagaggaacaatatttatgaaaaattgctggttatgtggtatatttattcctctgggtatttgaacccaagccattcaaaccaaaagagttgctttgtacttttaggtagattatttatcttttaatccatgtgaatagatctccagttatgtactttacaacctgtggagtggtatgtggcagcctgcaaactaattgggggtttgaaagttttggtgtttgttttcttgtgtccacttagtaccattaagtctcagaaatcctttgtgggcagctgccaggttcaccagcatttctctgttcaccaagaaggagaactactcagtttcctttggagactaccaggcattggagtcattgcttttcatgaaagatttttgcaccacaggtaaaatattcatgttgccaaagcctgctttgtttcatctggtagttatctcatcaaagccgtttctgtattttctgagggaaatttttgtaatgaaggagttgatgtaacttcactagatcttgctttttctctgctgtggacataggaatgataagcctgttatcactgggtttgtgttggcttgtgttgtttcaatgtcaagtcctattttcactgtggctttggtataaccatttatttactgtggccaacctatggagtgtattgtccctctcatgccgtgaattcattgtcactaaatgaattcatgatatgagaattcatctcaccaaatatgtttgcattaacaactcactaaatatgtttgcattaaatactttaaaatgcatagtgtccgtactacatggattgatgtcttcaatctatgaggatttttacccctaatttttgacttgacttttactttggtgcagctgattaacgttagcctgtatgatgaacaaggaagggctgggaggaccagcctattttagttactgtgactgcgtaagaaattaccctaaaacttagtggcataaaataaccatgtattgtcctcagggattccgtgagtcagagattcacacacacacacaaaaggcttaattttgctccattatgtatcagtcctcggctggaagactcaaaggctggaggctagaatcattcgaaggcttattcactcacatggctgttacctgaaaccttagctgaggctgaggcacctatatatgacctcttgatatcctggacttcttcatagcacagtggctggtttctttctttcttttttttttttgagacggagtttcgctgttgttgcccaggctggagtacaatggcacgatctcggctcaccgcaacctccgtctcccaggttcgagcgattctcctgcctcagcctccctagtagctgggattacaggcatgtgccaccatgcctggttaattttgtgtttttagtagagacagggtttcttcatgttggtcaggctggtcttgaactcccgacctcaggtgatccacctgccttggcctcccaaagtgctaggattacaggcatgagccactgtgcccggtcacagtggctggtttctaagggtgagcatctttagagagagagccacactgtagctatattgcctttccagtctggcctgggaagccatgtaatgttactttttccatgttctatttgtcaaggttgtcacagagttaagtgaaaggaaatagactgcatcttgataaaaagtggaggatcatcatgtgggatcagaaatgttgccgtggacttactgggaaaatacagtctgccaatatggcatcctgtggaggtgtccattttgcctcttcctcatcacttactgtacccatcttcctactttcatagatacccagaaatttcatcccagaactgtctcctttgcttctcaagggatagctaccatatttaaggagtcagagatgatgaaagacaggtttaatttttattatttgctctttgtgtttattatttaaattatttacccaggtgtgccatacttaaaaaaaaatgtatatgtgtgtgtatgtgtgacacacacacatctatcttttaaatttgatctatatgttttattttataagtgtatgtatgtacatgtaattggcgtattcatttacacaattttcaaaaccatatagttttataggtcttgagtttgtagagcctcactgccagtcttcttagagctgagtgagaggaagggattggagaggacttacctattcactatgtagattttttcttattatgcaggctctgtctgtacaatacaggcagtataatctgcctgtacaattagtacagtacaaattaatcagctgcacatgatgctcctgattccagagtccttctggttcattttcttcagagagtaaatctccagttcctatggtgattggctgtaggggaggggaagtgagagaagtcatgtaggggctgttacttgtatagactctcaacattttttcagtcctgaccctgccttctctttttgaaagataatttgtacccctatttctagagtttgtggggtaaatgaacttgctcctaggcctttctcacactgttaactttttctgtcacttaaggtgaccactgaagttgcttttcattttccaaaattttcttagggtagtcttttctttcattactaactatacctacactgttattttagtgtgccttgagcaaacatttatgttcagccttcctcatttttaaccttgacatctctcaagttgattgtcaacagtgcctaccttgaaggagaatttattaaataccaaactttaaaaaataaaatcagatgttaaaatggaatttatctttagtacaaaaagacatgataattttgtcagcttttatagtatatgaaaagtccaatattatagtgtatgatagatttttaaagcttttatctattttgaaatcctttttttctaggctataatcatattaaacactagaaaattattttatcagtcaaatttagagttgagcacaattaaggtgaccatatttcttgttttattatttcaccttgctgtggtttcatcaggcatatagttcttgggtctcatattatatttgccatgcataagtctgttactgaaaatgacctttacttctattgaaagattcttgggcagttattcaatgatgattttatacatctttattttgaaggcttactctgtgactatacacaagttgttcttgtctgtgtttcatattctttctttgttaagagagaataatatctacctgacattaggatgcttagcattaaacaagaatgttggtgaagtgcctgtttatgtatctgactagtattatgcatttagaaaggttgactttcctctcttgcttgtaatccaattgatccattctcttgttccagaaatgttttcttggaaatatgttatttttgaaattccacaaaatagcaatttactaattgtttgatgtgcatatataacgttttcatccatgtattggtgtacatatactgcttgcaaaacccaatttgtttactggcagtattgattaaaaatatatatacacagaaattttaaaatgccagttatttgtaaaaagtaaagagaaaacaattgtcaagtgttacttttttgagaattaggttttttttatcccacagaaaattgtagttattcatgtacattatttaataattattgaatacctaacatacattatggagtataattcaaaaatagttggcagccattaaattatgagagagatgttggattctatttagaaagattttcagcttggttttccttctctggaaattacatgtagattttattgttttttgtaatatgtataatgcacaaaacagtgcagtacacagatcttcattatataactcaatgaattattttatgtatacacctgtgcagtaccaccagattaaggcattgaatatctctctcaataaaaaggattcccttgtgctcctctaagtatagtcacgcatcacttaacaacaggcatacatcctgagaaatgtgtcgttaggtgatttcatcattgtgttgagcatcatagagtgtactcacatgtagatggtataacctattacacacctaggatatatggtatggcctgttgctcctaggctacaaacctgaacagcgtgttagtgaactggctattataacatgatggtatttgtatatctaaatgtatctaaacatagaaaaggtatggtaaagatacagtattaaaatcttagttaggcacagcggtaggcacttatagtcccagttacttaggaggctgcggtggaaggattgtttgaacccaggagtttgagttcagcctggacagcatagcaagaccttgtctctgaaaaataaatcaaaaatcaaaaattaaaaatctataatctatggcagtggtccccgacctttttggcaccaggaaccggtttcatggaagacaatttttcatcggacttgggtgtggggcaatggtttcagggtgattcaagcacattacatttattgtgtatttaatttctgttattactgcattgtaacatatcatgaaataattatacagctcaccataatgtagagtcagtgggagccctgagcttgttttcctgcaactatatggtcccatctgggggtgatggtagacagtgacacccaaagtgtgttgcttatgtccagtctactccataatctcattttggttgctgtcacttcagaaaacactgcttcataaagataggatgttggaaatggaagcaggcttttcagtgctgttgtagcaatctcaggatattccaccttgactttaatctggaatttacggagatgtgaagttgtctcaaacatacttttataaggccaccatcatttgcaatctcaagcagttgattctcttctagcacggacaaagttgattcacctggtttattcacaaatgggtcacagatccatgtaatgctcgaattcttttgaaagctgagacctatctcagaagttgccatagagctgtgtgaacagacctgagttaagggaatgcatttgtcaacttttgcttttgttgcaattgcttttgttgtcttcgtcatgaaatctttgcccatgcctgtgtcctgaatggtattgcctaggttgtcttccagggtttttatacttttggcttttacatttaagtctttaattcatcttgagttaatttttgtatatggcttaaggaaggggtccagtttcagccttatgcatatggctagccagttatgccagcaccatttattgaatacagaatcctttccccattgcttttttttttttttaatactttaatttctgggatatatgtgcccaacttttctctctggctgcccttaacatattttccttcatttcagccttggtgaatctgaccattatgtgtcttggggttgctcttctcaacagttgtaggtgtgtagcattatttctgggctttctgttctgttccattggtttatatgtctgtttttgtactagtaccgtactgtttttggttactgtagccctgtagtatagtttgaagtcaggtagtgtgatccctccagatttgttctttttgcttaggattgccttggctatttgggctcttcttcggcttcatatgaattttaaaatagttttctctagttctttgaagaatgtcaatggtagtttaatagagatagcattgaatctataaattgctctgggtagtatgaccatgttaacgatattgattcttcctatccatgagcatggaatgtttttccatttgttagtgtcctctatgatgtctttgagccgtcgtttgtagttttccttgcagagatctttaacttgcctagttgtgttcctagacattttattctttttgtggcggttgtgaatgggagttcattcctgatttggctcttggcttgactcttgttggtgtataggaatgcttgtgatttttgcacgttgattttgtttcctgagactttgctgaagttgtttatcagcttaagaagcttgagggctgagactatggggttttctagatataggatcatgtcaactgcaaacagggttagtttgacttcctctcttcctatttggataccatttttttctttcccttgcctgattgccctggttagaacttccaatactatgttgaataggagtggtaagctagagcctccttgtctacacatatatttacatcacccctaaatctgtttttattgactgtcttgtctcttgattgtcagtcactttcccctgctttacacatctgctaatttgtcgttgtatattgaacatagtgagtgaaatgtagagtaatggacaacatactatggccatgggccaaatccagccttctggctgttattgcatggcctatagctaagaatggttttttacatttttaaaggttattgtttttgctatgttgcccaggctggtcttgaactcctggcctcaagcaatcctcctacctcagtctcccagagcactgagattacagctatgagccaccatgcccagcctctgtttgtttttaaagagaatgtacaacagagactatgtgtcctcaaagcctaaaaatatttgctttctggccctttataggaaaggtttggactcttatttgttggagctctggattattaagtccctctaaataatagtgaattatattatggcaggcagttaaatagccagcagattactttgatcttatggagattagttttaagctttttaagataggtctgtttcacctttgttcttactcctaggacagagtttgtctagggtctcaactaagtgactaaggtgttcatcaagatatctctcctccgagcctggaccacaccttctcagaactgcacaacctctgaaatctctgtttagttaacagctattttctcctagaaattctaaccctgtgtacgcacatcctatgaagcaagtaaggaccaaagggcaatttcatgtgtatttttatagcttttttcctttcactttctcagttctaataacctatccccaaaaccctggcaccatagcaaccccaaacattaattttagttttcttatcctagcaggactaccactgtctgcttgggctttgtttctccacagtatggtttggcaggtgcccccaaggagaaagccagcgtgagacttgattcatctgcccttttctcccaaagatcatagccctgtgttggttggtatctgttgcttgtaaatgttacatacatgttttatttggtctatatttggtccggtttttatagatgcttgtaacaggagaatattgcaataccagctactctatatgatcagaaccccaaatcctcattattttaaaatatgaaaacgtatctcattatataatcagtgaattttgatttgaaacatttaacatgttacttgctgtattttctgattcattgtttacttgacccagatagttgagccaaataggacttagatctcagttaataatagtaaatatattcatcttataaaatcgaaatggcccttgctttccaaagatggaaccctaaacagctgggctaatggatttgatattttagaagatttcatctgcaacatttgagatgcaccttcacacaagttgatctgggcatagccgttgtcagagaagcttctgtccttggctgataaattattaatgcttaattatttaacttttttgtttgtttacatatctagcatcttaaaaatatttcataaatattttagcctatgccctttttttctctactgtattcacagtgtgtaaggaatacttggctgttgttttttttgttttgtttagagacagtgtcttgctctatcttccaggatggaatgtggtagtaccaccatagtttagtgcaggcttgaactcctgggctcaagggaatcctcccacctcaacttcccaagtagctgagactacgggcatgcgccaccatgaccacctaatttaaaaaattctttagagacgaagtctcactatgttgttcaggctggtctctaactcctggtctcaagtgatcctcccacctcgacctcccacactgctggaattataggcatgagccgcggtgcctggcctatttggctcttaaatgtgctgccttttgacttatttcatattcttgaagggaataatcatttaaatatttttgccatcatagtgctttgtatgtctctcctgaagctcatttaatagcatgtccatctgtgatagatgtgatctgttctttgggaaaggatgtatgacatagctctgttttcttcctagtacttgcataaagaaactttcagtattcattggaatggagttggtgagcatagaaagagttatagttatcacataaggaagctacatgactcactctctgctgcctcactgcttcccctgggtaattgtctgtcctgattcccatgtggattcaagaatcccccaaggaagccctggtgggaagacctggaaggtctggctctttgcccagatgctggtgttggtgttgatgttgatggatgtgctctgctgatcataatactctagagaagaaattgcatcttatctttgaacccaccattcataatgtttattcctaactcaaattggatagttcagtatctgtatatcaggaatttggtttcatattaaaggtaatatccatttatttgagtctttgcccttattatttaacattcttttcaataattagacttaataattatgcttccaaatgtttaaaataaagctggacttgcacatatatatatgtatactttacatatatatatacacagctttacatacacacatgtgtgtgtatgtaaagctggacttgcatgtgtatatgtatacacgtatacatgtatgcacacatagcaagatttacttttgaaaatatttatcctgaaactcctttatcctcttggtaattcagtatagtagctcttcctcttaaatattattcctagtgacattttatgactctgtttttccatttaccttttgaattctatccataattttttttttttttttttttgagacaaagtatcactctgtcaccaggctggagcagtggcgtgatctcggttcactgcaacctccgcctcccaggttcaagtgattcttctgcctcagcctcccaagtagctgggactacaggcgcctgccaccatgcccagctaatttttatatttttagtagagatgaggtttcaccatgttggccaggatggtttcaatctcttgacctcgtgatctgcccagctgggcctcccagagtgctgagattacaggtgtgagccaccgcctctggcctctataatttttagtgtatcagtttggtttccaccaagaaaagtgacagctgtactatgtgaggaattagtaatagtattatgacacttttttttttgaatgtgcagacatttccttttgatgattcatttgatttgtttatgataaacttcagagcatgtagttttggctttcttttgcaattatttaattttttcatgtaaaatctggatgttgataggcacttgatacattaaataggtacttaattttagcactaggttaatttacaactttggattcactgtattttttgacatcacttactttgaatcactgtgagatgactttcatttttcttcatcaagaatatcttgtgtgggatgtgtgctagttctttatatccttcgtttttgaaaatgtcttaagttttaccctagacttaattgatagtttgggtagagaattttagattggaaataatttctcagagttttgaaaatattgccttctattaatattgctgatgaggagtctgatactatttcaattcctgattgtttatgtatgacgtattgtttgtagacatttaaaacgtgttttccttttcacttttttttttgcttaaatttcatgtagattgtgcatgaaatccaccagcttgcaatatgacactcttttgctttccactatgcttgatgtccctagatttgaagccacttcagtttatcttagaataattcaggggaggtatgggattgagaactgagggacacaactgttccctacatggatcttcaaccttcctttcccatttttagcctcatgccttatcttgctgtttctcacacttatcctccaatgtttgagcctttctgtatatttgatttgcttcctgttgatatctttctctgcaggtatttggtgtttagctctgctgtctcttccacatgctttctatcttccaaagtgtattagtatcccctcccccccccttttttttttttgagatggattctcattctgttgcccaggctggagtgcagtggcgtgatctcagctcactgcaacctccaccttgcgggttcaagtgattctcctgcctcagcctcccaagtagctgggactacaggcatgtgccaccatgcccagctgatttttatatttttagtagagacggggtttcactatgttggtcaggttggtctcgatctcctcacctcgtgatccacctgcctcggcctcccaaagtgctgggatttcaggcgtgagccaccgcacccggcctgtgtgttagtatctctttagccgatatcttctctccttttgttgttcttgtggtttttatgtttttagtacattccttctttttttttccccctcaaattagtgggctttcaggaatgagtaaaggtaaacacattttcagtccatcacatttaactgtaggtttaagcatttttgaacagtaagttattaattctttttcctttagaagactaacaacagtggatggtggtttgccatgacatttgaagtcacattcttgtattttaattaaaatcaagtttttatttttgaagtttgcctctccccccatttctattttacatgtgttttggggactataacaagagtcaccttaaccagtttgtaatcaagcacctaaatattgcaatcttatctcaacctttattcttttactgtaactgcttcctcagtgattattatctagttaagaaattcatcagtttatcaaggctcattttgtttgacctctaggagctttaaaaactggtactgctccttatttcaaggaaagctctcttctctgtgatcacattctggatatacttcatctgtttcttttttttttttttttggagacgcagtctcgctctgtcgcccaggctagagtgcagtggctcgatctccgctcactgcaagctccgcctcccggattcacgccattctcctgtctcagcctcccgagtagctgggactccaggtgcccgccaccacgcccggctaatttttgtatttttagcagagatggggtttcaccatattagccaggatggtctccatctcctgacctcgtgatccacccgcctcggcctcctaaagtgctgggattacaggcgtgagccaccgtgcccagcccatctgtttcttacatatcagtattccttgaggatttactattgtcttttgtatcttttcactttcaattatttcgtggttgctgaagattgtggtatctgttatctctagtttggatatctttccacaactcaaattctgtgtttgctgaagatttcagtggtggttttaaaatcttcgaaatatttcttactgagagagagaggctgtattccctttacttgaaccttggtgagcctttatgagtgccgttttcttccaatagaatctgttgaaagagatgttgcatgacttccctcgctagcttagaaaagacccttcagcttctgctattgttttatggtaaactcactctcgaagaacttttagctgctctgtaagaagtctggctcccctgaggccaccatgtggagactctgtggaaagacaacatgctataactatatctttttgatatgttgtcttttcatattcatttagttcagaatattttccaaattcccgctagacttcctgtttcccccaggcattatttatatgtatgtcgtttagttttcaaatagttgaggattttccatatatctttcgcttaatgatttctatttcaattctgttatggctagagaacatactttgtatgatttcagttcttttaaatttgataaggtttgttttaagggccagaatatgacatatcttggtgaataatccatgtgcacttaaaaaggatgtctgttctactctttttgggggggaggcagggcggtggaaagggctagaaatatcagttaggttaagttggttagtagtatttttgtttttatattttaaaaaaattgagacattctgtgttgctcaggttggtctccaactcctgggcttaaacagccctcccacctcaggctcccaggtagcagggattacaggcacacggtagtgtttttatatctttgctgcttttcttttaactttgttctatcaattatcgagagagtagcattgaagtcttcaagtataattgtgcatttatctatttctttcagttatataatttttatcttttgtattttggagccctgttgttagatacccatttgggactgtgattttctttttggtgacatgactcctttattattatgtaaggagttgaatataaacatttttttctttgagatagagtctcgctatgtctgccaggctggagtgcagtggtgtgatctcggctcactgcagcctctgcctcccaggttcaagcacttctcctgcctcagcctcctgagtagctgggattacaggcacgtgccaccacgcccagctaatttttgcatttttagtagagacagggtttcaccatgttggccaggctggtctcaatttcctgacctcaagtggtccgcctgccttggcctcccaaagtgctgggattacaggtatgagctactgtgcctggccaaatataaacatttttaagccatattaaaagaaagcaagtttttatttggtagttgtatagggtctttcctacgtatatacttatttctataaactgaataacttctcccagcttttcaacttgtggaaattatcttgtttttcaatgtgttgtccatctatcaacttgcttaactgagatatgctttagttttaatagttttgaataatatttagagtatgtttctgtagaaacagcttttttttatatatccagattaatattaccgtaattttactgggatatggccttccgtttagtcataggtattaatatctatgaagtaatagtaatgtgtgtttattatgtccacagagttttcacttttcacacttgtttcattcttgtcagtaacaatgtggtggggcagttacctcttttttacagatagaggaatcaaatccagggattttgcggcttgcccacagccacgtgctaagcagtagagcccaggctagaacccaagccttttttttttttttttttgagagggagtcttgctctgtagcccaggctggagtgcactggtgtgatctctgctcactacaaccttcacctcccaggttcaggcaattctcctgcctcagcctcccgagtagctaggattacagatgcctgccaccacgcctggctaatttttgtatttttagtagagacagggtttcaccatgttgggcaggttggtctcgaactcctgacctcaagagatccacccaccttggcctcccagagtgctaggattacaggtgtgagccaccacgctctgccaatccaagccctttgacccttcaaactggtgtttttatttcccacaacatctgctatcaattggatggtcttctgtttcatctctatatgtcattgtgaaaagtgacacaaatttaaaaattaaaagttatggccatgaaagactaaatagtctgtgatgctgtttttcttatcttttgttgaacataagaatataatagtaagttactaaggaaggtttattagaagttcagattggtgcttttccacctcaattttataggtctgtgttgggacccaggtgtgtatatattaaatgagtacacaagatagttctgatgcacatattctctggccttacagagaaacacagttgggagagatggagactgccttggcctcattaacattctataattagccatatatttatagaacacattttcctatttgttcattgcatataccaagtgagacagaatcaaaatccatgttaaaacctagctgcactatacttatttttctcctcactcatggagtaggattttctgtttagtgtttttctaaagctgaatgagaaaataatctgtacaaggatagtgtttagcaagagcttttgagcccttaccggaaactataaactctaaaggaactgtaaactctaaagcaatgattcctaaatggggcagactttgcatctccccaacccaatctccaagggacatttggcaacgtctgtagacattttttgttgtcacagttggatggtgggtgctactggcctctagtggctagaagccaaggatgctgctaaacttccttacaatacacagtacaatccctcccctatcccccacaatagagaatgatcctaatacaaaatattgacagtgtcaaagttggaaaactgtgctctaaggttaatattcaataacatatttttgatgagtaaatttttaaaataatcttaggtgagtgtggttgctcacgcttgtaatcccagtgctttgggaggccgagacagaaggattgcttgaggctaggagttcaagactagttagggcaacatagcaagaccccttctctacaaaaataaaaaataaaattagtcaggcatggtggcatgcacctgtagtcctaactgcttgggaggctgaagcagaaggattgcttgggccaggagttcgaggttacagtgaactgtgattgtgtccctgtactccaacctggacaacagagtgagaccctatctctaaaaataaaatagttttttagctgcagttttgatctaactaggcgtttcttcttcagaaagttgagtcaagtgattttgttttgtctgtagccgtacccctatacatacacatttgcttcctaagttgatagtgtgcgttgtgagaatacttgaaggttgcttgaagatactaatcacacaatggataaataggtataactgcatcaacaaaccgattcacaaatcttttatcaccctgttggggggaaatctatttgagtttaacctttaaaggaaggcaaagagggaaagtagaatgtttcaaagtactaactttgaagtagggagcatttaaaatataaagtaaaatttgcaagttttgtgtgcatcagcattacatgagagtctccactgagctgtttgtttacttgctaattttccttggtcaaacaaaaacttcttcccattctgaatgaatgtgaactagtattttattgaggattttggcagtgcaagtgggccagaaataactttttattacaagtatagcatatatacaataaagaacaaatcttaaatgtaagacaagaatttataaggtgaaatctcctgtgaaactatcactggatcgagataatagaatattaccagtacttcagatgcgtccgttgtgcttccttactgttactatttgtctcttgcctaaagtagtcaccattctgaggtctgtcattatagtctagttttgtttttgtttttgaatgttattgagttaaactatatgagattgtgtttttataggttgtaattataagcaatttcatatatgtagttcaatctaagtattttttccccattgctgtataatacttcatttatggtagctagtgtcaatagatggccccctacacgtacacttgatactcacaccgttgtaaagtccctcaccccttgaatcttggctggcttctaagtgactcacttttaaccctgacagtaaagttaccctttgtggctcccagtcataagaagccttgcagcttccaattgggtctccttagaacacacactcttggggacagtccattttagacttcagctgtcatgctgtgagatgttctcaccatatggagaagccatatgtcagtgctctggtcattagctccagctgacctcccagccaacagtcagcatcagttgccagccatatgagcaaggcatcttgtacgtcagattcaatcaaacttctgatgactttactatctgctgtctaactgtagccacaagtgagaaccgccatgtgggcccagtcaacccacagaaccatgagtaatactaatatttgtttggtttatgtttgtgtatttgtcttagcattgtggtgtatttgctgcatagcaacgtaaaatgcatcattgcatgaatataccaaaatttattcagtttactgttggtggacccttgatttgtacactttggggctactatgaatactgtagctctaaacagtcttacaatacatatattggtgaatatattcatatacttctgttgggcaattatctaagagtggaaatgctgggtcagcttcaggagacactgtgaaacagttttccaaagtggctataagtatgtatgctccagcagtttatgagactgcatttgtcccacatcttcaaaaataccttatattttaaaattttagccattctgttgcttatgttgtagaatttcattgtggttttaccttctgttagtgaattttcccaacatcttttcacttgcttttcccaacatcttttcactttcttttttacataagtagaaggctctacaataaaaagtataggatagtaaatgctaggtgataggaattttttatctccattataatcttttgggaccaccatagtatatgcagtttatcattgactgaaaagcagttaatgaggcacatgactgtactgaaagctttcccctgaaactggaaacaaggtaagaatgtccactatccaccaccctttattcattgtgttttttgggtttttcttcccatatatttgttgaccatttaggtttccaattcttatctcactctttctgtggtttgtcagtgatttttgtttctcatgctgaaatctcctactatgagggatttgtccatttcttcttttaggactgtcagctttttactttgtgtgttttttttgaacggtttaattgagatgtgattcacattaaagtggatgattcaccttttaaaagtgtatggttcaatgtttttatgtatcacagaattaatttttaaaaattgttgtaaaatacatataacgaaatttaccactttagccatttttatatatacaattcagtggtatcaattaagttcacaatgttgtataacctttcatgtctacttccaactttttattttgccaaacagaaactctagccatgtggcagttgttcccatgattctctcccctcagctcctgttaacctcgaatctttgtttctctatgaatttacctagtctagatattggttataagtagaatcatacaatatatgtcttattgtgtttggcttatttcacttagcttaatgttttcaaggaagcatgtagcatgtatcagaactttcacttttttttcattccagaataatgttttattgtatgggtataccacattttgtttactcattcatctgctgacaggcacttgggttgtttctaccttttacttatgtgattaatgttgcaaacattggcatacaagtatctgttcaagtctttgttttcaattctttggagtctatacctaggaggagcatttctggatcacgtgataattcagtgtttaacctttaagaaactgccaagctgttttacatggtgtctgcaccattttaaattcccaccagcaatgtaccagggtgcctatttatacatatcattaccaacactgttattttccaggttttttttttaatagctatcttagtaggtgtcaagtggttacattgtaaccattgtaggttacactatttttgagactgcagtcatttactgcataataatgtttcatgggccatagtcacaaaggtgtgtattcctatattttcctccaagacttttgtagttctagctattaattttaggtccaaacttcatttggagttaattttctatatggtatgaggtaggggtccaatttattcttttgtatgtggatatctttttgtctcagcaccatttgttgaaatgataattgatatggtttgaatctgtgtacccacccaaatctcatgtcagattgtaatccccagtgttggaggtggggcctggtgggaggtgattggatcataagggtggtttctcatgaatggcttagcaccatttctcttggtattgtcctcgcaatagtgagttctcatgatacctggtgtaacacctctgccctctctctctctctattttttgagacgagtctctgtcacccaggctggagtgcagtggcgcggtcttggctcagtgcagcctcagccttccaggttcaagcagttctcctgcctcagcctccagagtagctgagattataggcgcccgtcaccacgccccgctaattttttatttttagtagagacggggtttcaccatgttggccaagctggtctcgagctcctgacctcaagtgagccacctgcgttggcctcccaaagtgctacaggcatgagccaccgtgcctggctcaccctctctctcctgcacctgcttctgccacatgagacaccttgctctctctttgccttccactatgattgtaagtttcctgaggcctccccagaagccaagcagatgccagcatcatgcttcctgtacagcctgtggaactgtgagccaattaaacttcttttctttatagattacccagtcttgggtatttctttgtagcaatatgagaacagactaatacaataattcagcagtacccaaactttttggcaccagggactggtttcaaggaagacaatttttccatggatggggggtggcagtagggcgtggtttggggatgaaacagttctacctgagatctggcattagattctaataaggagtttgcaacctagatccctttcatgcacagttcacaatagggttcatgttcctatgagaatctaatgctatcactgatttgaggaggtgcagcttagacagtaatgcttgctagctcaatactctcccgcccatcgctcacctcctgctttgtggcctggttcctagcaggccatggactgatactggttatggcttaggggttggggacacctacaataattcattttcacttgagtggtcttggtattcttgttacaaatcaacaataaatggaatagtttatttttggactctctattattttttgttccaatgtctacccttatagaagcaccacgttgtcttataggttcgtagaaacttttgaaatcaggaagtgtgagttctccaacattctttttaaatattattttggtgcatacacatttaggattgctatgtcttattggtggattggccctttggtcattgtataataattctttgtccctgttaaactctttagctctgaaatctattttatttgatattataggcacatctttcttttgattaatgtttgcatggtgaatcattttcatcatttaccttcaatctacctatatcattatattttgagtttctttgagacaacatatatctgggtcatgttttttatatatactctgccaatatttgagtcctggttgaaatttgaattcctacagagaggacttttatttacttctgcaagtaacctgttggcatcatcatactagaaccacttgaagtttcttttttcacttgggttttctgactacgtcatagtaagttctcaacagacagacaattttgattttattttttaagttattgttttgtttttctttgccattctatgtggtatgatttttgttgttgtttacttttattctgtgagaatagctcatagaaagcttgtgggtctcttattgtatatccatcctgaatagaccttaatatcacttttgattcccatgtatattctgtgatcaaaatcggaggtagaaaacttaaggactagaaactgaccttaacaggtcttactaggtaggctccctggtttcactttgctttggatctttgtttctactttttttccatgctagctcagtaacagactaaaacaaaaagtttcgaaaataatttatctggcaattttattgtatttgagaggagttttccataatacgttatctcctgtactgtctgtcaaaaagaggagtcatttttttttggtgtctttatttgcacagaaagttttcattttaatatagtcagatttatttacttgttttctttattgttcatactgtgggatctttttctgagaaagtttctcctattttgaaaatataaggatattctcacataatttcttctagaaattttataattgtgctttaaatttatattgaatttttctgtatgatgtgaaataagaatcaactttttttcttactgatttttcaatttgatttcccccctatttttaaggagatacttgtatatctttttctccttattctgttaatattagtaattacatgtactgcatttgcaatactgaattttccatgaaattcttgtacctttttttttactgtgatgcaaaatcagtttgctaatattttatttgaggtttttgcatctctattcctgcatgtgatttgcctttatacattcttttacgcacattccctcttgaattagaatcataagactaactgggtaacagtccctgccttctcattctttggaatagtttaagtaaactggagattatttgctctttgaaggttgttagaacttcacaggtttgataaaagctttcaatgtcagatgatttttatgtgtgagatttttaaccacttgtttttctttaatggttataggtctaagtgctctatcattctgttcccttttttattctgatctgtttgtttaatttgcttctttcacttccttcattgttcttctctagtcttgtcagaagtttgttgttaatctttttaatccatctttaagtaattttgtggtatggtgcagtttggattttgattgttttattctttccatgtggctatctagttggcttattgttatctcattgaaaaagaccttcctttctcgtgctcttcagtactactttgttgtaaataacatttgtgtaggtcagttttctgggccctttttcctattctaatggtctcttggtgtatctgcatgccaatccatattgtcttaattattttagcttaataaataagtttttatattggatagagcaaatccttttgtatctttaatacttttaatcatttaagtttgtaatctctatagttctaattatttgaagttttaaagggatataattgagtcctgctaactcttgttaataaattgattactcttgtgtcttataattttgtattgtgacctggtcatcaggtaagtgttaactctgtgaatcaccttcagtcggagttacggatgcgttcctgaagatgttttattttcacctcggactaatttttttttttaatcacagtgtttcacctttggggttctgtaaacagtatataatgtaaaatcaaacttcacacccacgtgagacttttccttcttcattccagatcccatttggaggcagaaaaacttaacttgttctcatcttgggcttatgggaggatttttccccctcctagtctacctttcattcagaaatgttgctatccagactctgggctttcactgggaaagacttagttctgtatctcaccttatttaggcccaaggcctgcacatttttccacctgtttgtgataaacccgaattgctcggttatttttcccctctcttttttccagtgcccacctgttttctgattgatatataatacttgtacatatttatgggtacatatgatacagggtgcatgttacatgcatagaatgtgtaatgattaagtcaatgtttagagtatccatcaccttgagtatttatcatttctatgtgctgggaacatttcaaattctcttttctaggtattttgaaatatataatacttgtttttaactatagtcaccctactctactgaggaacattagtatttcttccatcagacaacctctcatcacctctccccaaaattcacacacctttcccatggcttactttttaagaaacctgtccatgacaaccctagcacagttacacccaacttctatttttcctttctgcacactggagatttcttttcagcttagctatgtaattaaaagggtatttgttaatattatccagcatgttttaagtattttgttgctgagatttctagattatctagtctgccatattgctggaaaaggaagttggtattttaaaataagctatacaaagcaattgtatattgttggctgaaagaatttcccccttcaggtgggagtactaaatataatacccttccattgttgacacagttaaaaactgtgtctttgaagcaaagtattgcatagtggctctaagcatggactctggagcttgataatctggggtagagtataagtcctgccactcatgacctgaatgatctttacaagtctgtgtaatctccctgtgcctcagtttttcatctttagagtcttaatagtaactatctcatagggttgttttcatgattaaatgagtcagtccatatacactgaacaacagtgtctggcaatagtaagcagtgaataagtttagctattactattgttgttattaacttcattagatataactcttacttagagctcttatcctgtatgtgaaaaattttccactgacttacatatagacagcatttttcattttcaacgatagcgtccatactttgtatttggagtactgtattgtttggtttcccttcttcctgctttataaaggagctcagggcagaaaatggagtctattgtcacttccttaagccactactaaattttaagttatccatcagtaagtaatctttttcttatcaaaatcagtatgtttatgttatctctttttttgagacagagtctcactctgtcgctcaggctggagtgcagtggcacaatctcagctcactgcaaccttcgtcccctgggttcaagcaattctcctgcctcagcctcctcagtagctgggattagaggcgtctgccaccgcgcccagctaatttttgtatttttactagagatggggttttaccatcttggccagggtggtcttgaactcctgacctcgtgacccacccgcctcggtcccgaagtgctgggattacaggtgtgagccaccgtgcctggccatttatgttatctcctgaagtttctgccttctcttattaatcactccctcaaatgaagatgtattcctatgatggattcttcattcagtgaggtgatcagtctatattctctataaggatctgaaggatttcagtcactgttaagtctgtatgcctttggactaaacattatggaacgaactggttcttacagactttctttcttactgacctgcccaacctattaaataattatgttttttcttatatggaaaatagtccctctgtccatcttcaggagagcatctttagaaatgtggaaggaaccggccgggcatggtggctcacacctgtaatcccagcactttgggaggccaaggcgggtggatcacgaggtcaagagatcgaaaccatcctggctaacacagtgaaaccctgtctctactaaaaatacaaaaaattagccaggcgtggtggcgggtacctgtaatcccagctacttgggaggctgaggcaggagaatggtgtgaatccgggaggcggaggttgcagtgagccgagatcacgccactgcactccagcctgggtgacagagtgagtctccgtctcaaaaaaaaaaaaaagaaagaaatatgaaaggaacctcagagatcactatactagttgtttttagacacttaaaaataagtgtctttccagtgaagatacgcatacatgcatacaccactacacacatggagacttcatatgtgtatgacgaatcaagttcattattatagttaaagctaggagcccagatttggccttcttagacttttcttcctcagtaactcagcctgagacactcaaggagccttagacattacacagtagaactctggaactgctgatcaggtctttcttgtagtttagggttgatgaaactggcctgtgtagcaagaaaaattcacccaagactactaactagccaaataagaactcagccttagtgatggcagtggcagcctgtctggagcggccgctgcaaagacaccaactgcagtgggggacgcgcagctggggctgtgcactccacggagcctgcgggagctgggaacaggtgggagccctgccccctttccaagttggcagagtgggaaacctgcccttctgggggcaactgcagctgcccagccacggctgcagacctgggcatccctgtgctctcgcggggtccaggaagcccctcagcccctgcaggcttggaagtacctgctcccactgcctggcctctcctcgctcccagcgcctgctccaatttccaaagttgaggccaagcccaggtgctgtggcgacctagctgggtgtgtgtgtgcgcagggtggtgataacacaccagcctccttctgcctcggccccctctggactttgggcgctgatgagcacaggagggaggcctgtagggggctgaggatggctcgtcacgggcctccaggcaaccctcagctccagcagcctgggcaccgtggacgaaatgattgatggcggcaggaagctgacaggcttctgggcgtaaaggggaaggttcccggtgaagccccaccttcaagccagggatgaccagaagcatgggggctgggctgtcagttccaagttgagtccacagcctggagggggataacttaaagtgctttttctgggcccacgcatggccacccatggaccggttagcatgcacttcctcccttctgaagtccctaaaaacagcccgattcacacagatgttgggatttaccagctgtgggaaggagctacccactttgggttaggtctcctcgactcttcgaggcaatctgtctgtgggaaggggctacccatcagaagtctcctctccactgagggctggacacttgtcgggtcgacctgcctgtggaaaggagccacccaccataggtctcctctccaccgagagctggacacttgtctggacgacctgcctgtggaaaggagccatccactgtgggtctcctgagagctatgctgtcgctccgtgaactcctctctgccttgctcacctccagttgttgacatacctcattcttcctggagggaggacaagaactctggacctgctgaatggcagtactgagaactgtaacacaaacacggctaaaacacgccccctgctcgccatgttgtgggcaacgagaaggagagaagagctgcagcccttcggggaacccatacctagggtacccttttaattacgtagctaagctgaaaagaaacccagacctgtgacaccctctttggggttcttgtgttcctggcatctccaagcttccaggcaccaccgtgttcccctcatctagattcaggtgcccgcatcggaagtctcgtgtgttacatctggtccagccacagccttgcatggagctggcacctatgccagtgcctggggctgcctgccctggctgtgtgcagtggctggaccctgtgctcactcgcccacacacccctcgctgctccgcgcctgactcgcccttggcaggtgtggaatccaggccggtagcgcgagccaagcttccttccagtaggaaatatgatgggaaaacaggaaggccgtttaattcagattaatagaagaagtaggtttcaatggagacttcaaagggaaaatgtgaacacttttttttaaaatacttttttttcctttttatatcatcttgtatttttcttcagtggatgatttctggttttattgtttgtttgcttttttatttccaacttttattgtaagttcaggggtacatgtgcaggatgtactcctgcacatgtaccaggtgtagcctgccaggtcaagtgggcggaacaagcccagcgggtatgagcaatactcaggcagaaggtgccgccagccaccgaggtttctggctgccgaagtgacaccccatgaattctgtgacattaatatttactgtttccattttggcttggaaacatactaccttccaaagtattttcccctgctgcaggtctgcagagctgctgctttgtctttcctgcaaacttgtcttaacatatctctccttgtacttggtctgccaacaggaagctccttttgcctggcagttgttattgacttaaaattctagtgataaagctaaataagatctgtcgggaccagtctcttcatctttagagaaacaataaccagtaaattagtttctctgtagatgtattatcccttgagctttagagattctttcaagtaccttgttctctagctggtcctcttgtgaaataagaaagactgaagaatctgcaacactggcaaaggaactaaaagcacataaactttaaaattgcttctatttgctgttttatcattcactcattcagttattcaactaaccaaatatgtattgattgttttatttaacagcctactggggattttggtatatgttagaattctggccacagtttaccaattacatttatctctctttcttacagttaagtgttgccttttgcctgtgagttttcttatgtacttattctctctgcctgaaatacccgcctccaaacctggtgaacttttattcatccttcaattgtaacttaaaactcccctatttcaggagggtttttctagcactcttgagtgaattaagggttttttcccctatggctttcttatcataattaaattaattattttaattagttttcattcccacaccctcacctcaagtccccttctccaatatgatacccatggcaatactaattttaggagaatttgctatcataaggttttttcagtcttgtattttttggtcctagcaatgtttctgacacatagtagatgctcaatatatatttattgcatttcttatactcgcagaagatttatagtgctaataatgcatgtatagtatttgtcttccaagacattgtttccagaatcttctgaagtgagtgatgagaggacaaaactttcaaacacataaatatgattactaaatgttgcctttgtccaagaaatacttaaaaatcatttagttcacttgttaagtatatcagaagtagcaacaattttaaaaatactttttttggttagtttacattttaaaaattgcaataaaaataaaactgcaagcaggcaaccaaacactgatataagactgtagaccaaagtgttcaagtatttcttataattagaggttccttattatgaatagtatttgaagatacttcagtgcttaggtaaatatcaacaaatgtgaaattattgtacaaaatacattacaggacatatacattttgctatatgttgcaaatatatatatttgctaagccatctagttaattgactgtatttaaaattttgtcatcagtatgcagcttgcttagagagtaagttgtattgaatttgagaaattatgccttagatttgtgacttattgacaggcttccttccagtggaaagtatgaggggaaaacaggaaggccatttaattcagactaatagaagaagtaggtttcaatggagacttcaaagagaaaatgtgaacacttttttatttaaatacttttttttcctttttaaatcttcttgcatttttcttcagcaggtgatttctggttttatagtttgcttgctttttatttccaacttttgttttaagttcagcgatacacgtgcaggtttgttacacaggtaaatatgtgccatggtggtttgctgcacagatcatcccatcacctaggtattaagcctggcatccattaggtattcttgatactctccttcctcccacctcccaccctctcacaggtctcacaggtgttgttcccttccttgtgtccctgtgttctcatcattcagctcccacttacaagtgagaacatacggtatttggttttctgttcttgtgttagtttgctgaggataatggcttccagctccattcatgtccttgcaaaggactgcatagtattccatggtgcgtatgtaccacattttcctaatccagtctatcattaatgggcatttaggttgattccatgtctttgctattgtgaatagtactgtgatgaacataggcatccatgtatctctacaatagaatgatttatattcctttgggtatgtacccagtaatgggattgctgggtcaaatggtatttctgcctctaggtctttgaggcattgccacactgtcttccacagtggttgaactaatttacactcccaccaacagtgtaaataaaacattcctttttctccacaacctcaccagcatctgttgttttttgactttttaatagccattctgactggtgtgagatggtatctcattgtggttttgatttgcatttttctaatgatcagtgatgttaagctttttggttggccgcatgtatgtcttcttttgagaagtatctgttcatttcctttgcccacttcttaatggagttgtttttttcttgttgatttgtttaagttctttgtagctgctggatattagacctttgtcagatggatagattgcagaaatattctcccattctgtaggttgtttactctgataggcttttttctttttttcttttttcttttagctgtgcagagctctttagtttaattaaatcccatttgtcaatttttgcttttgttgcgattgcttttggatattttcttatattttaaccgcccaccagatcataattttaaaaattattttgaaaaatattttttctcattaataaaaccctagagggtttgaaagtgtaaaatacaaagttaaaaacccttgtgcttacacattactgtaataaacttgtgtattcccacattttctctgcatatgcaagcatacatacacatacatgtatgtgtctatgtgtgtgtatgtgtttatatgtatacattatatattcttagagttggagtcatggaatacttcctgctttctgttacctgctacttttcctctttctgtatgctttttacatacaaagaatctttttggttctttttaatgattgcagatattccattgaatgcatgtgtttttctgttacaatgaagcagagatgtatttatgcatatatatctatttctccagctgtagtactaatagtatagttgctagctcaaaaggatttacatttttaattatcttagtcacacactcccatctaaaaggcttgtgtagatttacacaatttatgttctctctaccagtttatgaatgtatctgtttcttctcccttcccatgctcattactcagcagccttctaaagtaaataatcatgggcttttactgcgtaatcagattagcacagtaaatggtggaaaaataacattattgattgaaaagttggttaagaagacataagcttgctgttgtttctttcatagttttggtgttaaaatttgctggtgtttgaggtaactaattttaactagattcagggtgacactatctgtaagaaaagatcctgggaacttgagaagaatgaatccatattcataccaggttagttcatggaaatatctgctctcaacatttaagcaaactaagaatgaataatttgttacagtttacaacatatgatttcatttattcctcacgtagattttaatctgttatgcagaggagtagagtgaaactcagaaagataaggaaggctccctcaggtcacagtttataaatggtggaacttttgttttgttttgtttttgatgaattatattgcatttctaatctaaggaagcacgtgtgcatcaggtcctagtataaggtctactaaataacagaggctcaataaaagtcttcaaattaatgaattctcttttgagaggaaatattttgaagtctttaaaggcattagtagggttcaagactaagaaagagaccacatggccttattactttgatttttactagggaaagttgtaagcatataaaagtagaaagaattgtaaaaatgaacttctgtatatccagctttataacagttattaactcatggccaaccgttttcatggtggaaatccactcaacacaagatgacaactcaaaaaaagctatagaaaacagaaaaattcaggtggactcatgatataataaaatagttattgaatgcctactattgatagacgtgtagagtagggttttggttgttttgtttcgtttttttctttttcttttgaagtaattgtaggttcacaggatgttacaaatatagtacagagaggtctcatttactgtttactcagcttctcccagcggcccaatggtaacatcttctctaactgtggtacaatattaaagtcccattagttgacattggtaccatctacagatcttttatagctatcaccagtttttacatgctgtcatttgtgtgtgtgtgtgtgtatttgcatggatgtgttactttttacatgtctagattcatgtaacaattatcaaaatacagcataaagtattatatatgatgttagctgtgagacttcatagatgttctttatcacattgaggaaagttctctattactaacttgttaaaagttatcacgaacgaatgttgcatttttaaaaatgattcttgtctgtctattgatatgatcatgtgacttttcattagcctgttactatagtggattaccacaaacaaataaattttaaacaaataaactaaatatggtggattatattgagcttttttagaatattctgccaagaattggtatgcatttttcttttttttttttttttttttgcaccgcccttaatccatttaatcctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccaccttccctcccggacggggcggctggccgggcagaggggctcctcacttcccagtaggggcggccgggcagaggcgcccctcacctcccggacggggtggctggccgggcgggggggctgactccccccacctccttcccggacggggcggctggccgggcggggggctgacacccccacctccctcccggacggggcggctggccgggcagaggggctcctcacttcccagtaggggcggccgggcagaggcgcccctcacctcccggacggggcggctggccgggcggagggcttacccccccacctccctcccggacggggcggctggccgggcggggggccgacccccccacctccctcccggacggggcggctggcccggcagaggggctcctcacttcccagtaggggcggccgggcagaggcgcccctcacctcccagacggggcggctggccgggcggagggctgacccccccacctccctcccggacggggcggctggccgggcggggggccgacgccccccacctccctcccggacggggcggctggccgggcagaggggctcctcacttcccagtaggggcgggcgggcagaggcgcccctcacctcccagacggggcggctggccgggcggagggctcacccccccacctccctcccggacggggcggctggccggacggggcggctggccgggcggggggctgaccccccccccccacctccctcccggacggggtggctgccgggcggagacactcctcacttcccagatggggtggctgctgggcggagaggctcctcacttctcagacggggcagctgccgggcggaggggctcctcacttctcagacggggtggttgccgggcagagggtctcctcacttctcagacggggcggccgggcagagacgctcctcacctcccagacggggtctcggccgggcagaggcgctcctcacatcccagatggggcagcggggcagaggcgctccccacatctcagaggatgggcggccgggcagagatgctcctcacttcctagatgtgatggcggctgggaagaggcgctcctcacttcctagatgggatggcggccgggcggagacgctcctcactttccagactgggcagccaggcagaggggctcctcacatcccagacgatgggcggccaggcagagacactcctcacttcccagacggtgtggcagccgggcagaggctgcaatctcggcactttgggaggccaaggcaggtggctgggaggtgtaggttgtagtgagccgagatcacgccactgcactccagcctgggcaccattgagcactgagtgaacgagactccatctgcaatcccggcacctcgggaggccgaggttggcggatcactcgcggttaggggctggagaccggcccggccaacacagcgaaaccccgtctccaccaaaaccagtcaggcgtggcggcgcgagcctgcaatcacaggcactgggcaggctgaggcaggagaatcaggcagggaggttgcagtgagccgagatggcagcagtacagtccagcttcggctccgcatgagagggagaccgtggggagagggagagggggagggggagggggagggggagggagagggagagggagagggagagggagagggcatttttctttaaatgtaatttttttctttaaattcaccagggaaaccatctggatctgattttttctttatgaaaagttgtttctaattcagtctctttacttatgataggtatatttaaaatttttatttcttcttgagttaatacgtgtagtttgagtctttctggcaatttgtccatttcatctacattatctatcggcatacatttgttcataatgttccttaacatctcttttttccccttgtaacttcagtattaatgtaccttcttttattcctggttttaataactttttactctttttttgttctttctcagtctacctaaaggtttattagtttttctgatcttctcaaaaaactaactttcggttctgttgattttctttattgttttttaattctctattttatacatttctgcactaacttttctttctttgtgctttgggtttagatttgtatagtgtcttcagataaaagattctttatatgagatcttttcttttgttatgcagtcatttgtagctataaatttttctccagtttacctgcatcccatcaaatgtgatatgttgttatcttcattttcatttatatcgaagtattttctaatttctcttgtgatttcttctttgaccccttggttatttatgagtgtgctatttaatatcgacatatttgtgaattttccaaatttctttctgttactgatttctagtttgattccatttgttgttggagaatatgttgggtattatttcagttcctttaaatttactgaggtttatttcatggcctaccatatggtttattgtggagaatattgcatgtgcacttgagaagaatgcccattctgctattgttggatggagtgttctgtctgacctgtcagtcaggtctcgttagtttatggcattgttccaagtcttttatttccttgctgatctctgccttgttgtttaatatgttattgaaagttgagtatgggagtctccaaccattattgaattgtctgttttataggtacatatatttttatgtttgtatcttctgatggaacgacctttagcgttataaaatttccctctttgactctagtaacatttttattttaaaactttgtgtgatattagtatagctgttccaccttccttacggtgtaactttttaaatcctttacttattatatatttgtatttctgaaagaaaagtgtgtctttctttagcagcatatacttgcgtcttattttttttttttaccagtctgacatccctgccttttgattgatttttgttatgtcagttaatgttattattgatatggttggatttatatttgtactattttactttttgctttttttgtttctcttttcctcctttattgctttcttttacattcagtgcatattttcttgtgtaacatttcaattcctttaatggttttttcagttttcttttttttaactagttgctttaggacttaaccagatacatcttaacttatcagaatacttcaggcttataataacttaattacagtgagatatagaaatgttactttatatagctcagtttcctctttccccttcttgtgctattattcttatatatacatatattacaaacccaaaaatatattctgtaaaattattactttatataatttatgtaattttatgtctagtaagctgagagaagagaggagagcaagtatgtatatatagaaattgtatattagccttctattgatcatttctggtgcttttcatttctttctatagattcacgttaccatctggtatcatttccataggccaaaacaactttgattccactataattatatacatatacatatatatgtatacatataaaaaaatatatagagtatatatatacacacatatggttttatactatttatactataataaatcagttaagaaaaaaaggagatactctatatacacacacacacacacacacacacacacacacacacacacatatatatatatattttttttttttttttgagacagagttttgctcttgttgcccaggctggagtgcaatggcgtgatctcagctcactgcaacctccgcctcccaggttcaagtgattttcctgcctcagcctcctgagtagctgggattacaggcatgcactaccacgcccagctaattttgtatttttagtagaaacggtatttctccacattggtcaggctggtctcgaactcctgacctcaggtgatccgccgcctcggcctcccaaagtgctaggattacaggtgtgagccaccatgcctggccagagatactctgttttatagttactcatttacctgtaccagtgctctttggtttttcatgtaaattcatatcactgtctggggtcactttttttcagcctgaagaacttcctttggtatttcttgtaaggtggatctgctggcaacaaatactctcagtattcatttatgtggaaatgactatctttattttgccttcgtcttttaaagatgtgctgagtacaagattcttggttagtgtttttgcctctttcagtgctttgaatatgtcatccaggtgtcttctggcttctgttgtttcttatggcaagtcagctattcatgtttttggagtttcctcgtacatgaggagttgtcattttttcttttgctgctttcaagatattctttgttttttgggggcatttttactctaatgcttcttggtgtggatcgttttgcatttattgtacttacagttcattgagctttttgcatgagtagattagtgtttttcatcaaatttgggaagttcacatccacatttctattttttttttctcctttttctttttcttttttttttttgagatggagtctcgctctgtcacccaggctggagtgcagtggctccatctcggctcactgcaagctccgcctcccggattcacaccattctcccgcctcagcctcccgagtaactgggactacaggcgcccaccaccatgcccggctaattttttgtatttttaatagagacggggtttcaccgtgttagccaggatggtctcaatctcctgacctcgtgatccacctgcctcagcctcccagagtgctgggattacaggcgtgagccaccacacccagcccacatccacatttctttaaataatttcttccgtttccttctctcctctccttctggtactgtcattatacatacattggtgggctcttaatggtgcttgcatatctctgaggctcttaatttatcttctttttatttattttttttgagacagagtctcactctgtcacccaggctggattgcagtgatgcaatctcggctcactgccacctctgcctcctgggttcaagcgattctcctgtctcagcctcctgagtagctgggattgcaggcacatgccaccacgcctagctagtttttgtatttttagtagagacggggtttcacaatgttggtcaggctggtctcaaacttctgacctcgtgatccacccacctcggcctcccaaagtgctgggattacaggcgtgagccaccacacctggcctcttcattcttttttctctgtattatttggattatataagctgttgatctgctttcaagtttgctgattatcttttttcagttcagatctactggtgagccccttaaatatatttttcatgacaggtatttttgtgaaaaaccatttgattttgttttataatttctatctctttatattttgtatctgagatattgtcatcatacctttcattacctctttaagcatggtctcctttagttctgtggatatatttataatgactgctttgaagtattgttcagtctgacatgtaggccctctcacgagcagttcctgttacctgctatttttcttctgtttctcttatatgtttctgtttcttctcctgtgttatgttttcgtttaaacttgacgttttactttattttatatgtttttgagatagggtgttgctttgtcacccaggctgaagtgcagtggttgtgatcatggttcactgcagcctcaacctcccagactcagttgatcttccccctcagcctcctgagtagctgggattacaggcacacagaaacacatctggctaattttgtactgtttttgcagagatggggtttcaccttgttgcccaggctgatgtcgaactcctgggctcaagcaatccacccacctcagccatcccaaagtgttgggattagaggtgtgagccaccgcatccaagcaaaccggacattttagattgtgtattgtaactattgataatatattgacccctcccttccaaggcttgtcgttattgtttacttgtttttcagtgatttgattgaactattttagcctctgatatcttctcacagtgcgcacagcattaggcattctcacagtcaccctgggatgacagtggtttatcagggctctgtttgactcctctgatttctgttaggttaactacctctgtcagtttcatatgcagctgttaagcttcaataattattgtctaatttctacatttttttcatcagtatataaatagagcataaattgttccacagtcttgatccagttaaatctaagcccctttgcagggatagttcttgaggccaatctttgatgtttgttctgactctaggagggttcttactttatttgtcttacctgcttatcgtatttccctggttatctctggtaaactagctgacgtatgttgttttcaagagcactcttagactggaacttctctatactcgctaccaaataaagtcagtttctttgggtagagttttaaagttttctgttcttgtggcctgtctccctttaacacagcttctccactgccctggagctggggtggggacagtgttcggcttctcttggagtgaaactcctgccttacaagcagggctcttgtaggggcagtgtcctttacttgatttgcctctccctacatggaatttctgccctatgagtaagctgaggcaagggtgattagggctcagtattctggaccatctgtgtctgaggtagagtcttgccctgcaggctttgggtggaggaaggttgcttttgattctttgacataccattctggaatttaaattgtgataatgttgctgggaagcatgagaagtgctggtggtctgcctctcctatatcccttgactaggatctggggaagaagggatttgcatcttcctggccatattttcccagagtggaacattggccagggcagaagaaggagggagtgggttgtggctcaagtgccacagggtcttgctgattttactgagattgagtagactttgtggaataaatgctgttttctttgttactttcttttaggtgaattctccaagactaaattcttgctttttgtttttgttttataattttccctaatagtagttgttatgctcaggagcagatccatagagttcctttctgtacattattacttgattgatttttaagcactgaaccagccttgcatctgtggtaaaaccccatttggtcatgtgtataatccttttgagatattgctcagttcccttgctactattaatattttttgaggatttttgcatctgtgttcatgagaaacattagtctgtagttttctcttttatactgtctttttctgtttaagtatcaggccaatgctggtttcatagagcaatttgggaagttccatcctctactgttttctggaggaagattgtgtagaattattcttaattctcatctaaatgatttgtattttttagacttctccagtgaaatcaggcccaggagatttgtttttggggaggtttgctttgaaactgttgttaccggtggaaggtgtcccgagttaccggcagtgaatccttacaggtctgcagcaaccttaattcttgcctccttataagaaagaattccactgagggtcatatggtagaaaaagagactgaggcaagtttcagcaggagtggaagtttattaaaaagctttagaacaggaaagaaaggaaagtgcacttggaagagacccaagtgggcaccaagaaggtcaagtgccacgtttaactgtgatcctaggactttataggacttctggcatcttggaacccttccccatgattctttccttacggtgggctgtccatatgcacagtgcccttcttaccctttggaagtgagcacatgcagtggatttaggaagttttatacatgcccatctgaggctttcttcccttttccagtggtgtgccctcggaaagccaggctctgctattttgtctcttaatgcacatgcctgggttccctcacccaacacctgagattttattggatgccctttttacttctccctggggcctgcattcaattaacactttataatgttaacagctgtagattatcaggagattgtctgtccctgcctccggctgctgaattatctttagagaggcaatgcaataattgtggaaccatcacctgatcacctgacattcctggtggatggggagagccctctcctgcctggcttatgcctgcctaactacctgtaacactatgatttcaattttaaaattattgtgtgtcttttaaaatgatctatttcatattaggtgaattttagtaggttttggtctgtgaggaatttgtctgtttcatccaagttctcaaatttatgcttaatagattcctttctcctattttgttaccttgtaaatgtttttggagtgtgtagttacatcctcagctttgttgggacaactaaattcctcttcaaagactcaacttcctggtcataagttgtaaatcaaccctacctccttcttttttccgcttctccttttcttgcagattgcgcgtttaccctatttgggaaaaaaaattaggtctaagccaacggggatcagcttaggttgtgcggtctgaccccagccaacaggggaaggacacagaaacaggagctgtgttagggttaaaaaccccttccttcctttgttcagtgtgctcttgcagttgtaacaggtgcaggcaacacccttccaccaaagtaaaagtgccttgctgagaaattttctgtttaggtgcgggtttcttttggctacgccaagcacttgtttctgacagcttcaattctgtaaaggttgatttgtgtctttttttcccctttttattttagtcttgtttgaggtttgttaatttcattgatcttttcaaattgaccagatttttgttttaccaattttgtctattttttgttttcaaatacttagatttctgctctttcctgtattccctaattttggtttattttctctttttctaattttctttaggtaggagcttagacttgatttgagaccttccctttttttaatgtaacatttaggtttataaattttcctctcagctctgctttggccttattccacaagttttgatatgttgagttttctttcagttcagtggttttttttgttttgttttgttttgttttgtttttctccagagtcctctttgtcctgtgggttatttagaagttgtttaatttccaaatttttcctatctttctctcactgtgttctattttgatttcattatagtcacagaacacactatgtgatttcagttattctgaatttagtaaggtttgttttatgacccaggatatagcctgtcttgtgaatgttgatggatgcttgaagagaacatatattctgctgttgtcgagtagagtgccctagaaatgtcagtcaatcctattagttaatatgttgttgggttcttttatatccatgctgattttcttttttacatctttgctgattaatctagcaattgctgagagagggatgttgacatccctagttatatgtgtcccttttctatggcttaagttgttttctgccattttattactagttttatgactttattatttgtttccttattttctgtttgttctgcttttcaattctgttttactttttctgctcttcttagatttgtggcattttctagaatttcatttttgtttttatagtgtctttgagagtagtgtctttgagtgtctttggatagcttttttaggtgattcttgctattataatgtacattaaaaattttttatgctatatcattaacaacattttaccgctttgagtacatataaaaaccttatctacttttagagacctttgccttccccctttataatataattataatagtattgtgttttccccaatataatataactgtgtttaagtatttttctatatacattaggagcacatcaaataggtataatttttgctttagcctttaaacatttattcttaaagagaagaataggcttttttatttacttccatttctcccatttcattactctttcttcttttctgttgttccaagtttcttcatgttacttactttctggttggagaacttctgatagggctctgatgactagaggaacaccagggtcctttgtctcagaccgattagataaacaacacggacacatgtggcatggtttcaaggtttcagtgagtggaaagtttaataagaaagaaggaaaaggctcccccatagagagacagagggagcggggctctgaacgaagaggaaaaccctgagtgcaccagaaaacagtctgttatattaggaggctggaggaggcggtgtctgatttgcatagggctcagggcattggtttgaccaagtgtgtcattcacatagtctgtgaaaaacctggctctcccaccctggccttttaatatgcaaatgcaggtctccatgatgtcctgcacacgcggagtcatctggaggcagccatgacacttggcacacatggtgatgaggaggagacggaggaattaccatgctgaatggacccagtttctaatcaccagcatttgcatatcaaagcttgctggcctggctttttaagctgcttttctattagaaaagaaatgtttgaggagctacctttattaaaagaaaaaaaccttactgaggactccttaccctatctgcgtaaaataatttcttaataactcccgtaatattcccccctgaggagatgtcaccttaactgctgttagagagttttgggtgacgactctttctggccacttcctgctgaaaaggggcgtcaagtggggaagagcagctagggttcctcttggagtcgatctaagggtccttggaagaatggcctgcccatgcatggttcgttttgcagcaccatttggagtttgattgcttctaggcaagagaaaacaatttgagttatagtattgagtatacaaggtgcaaatatgaatacaagatgtgtaagcaagagggggcttaataaaagagctaaccaattccgtaaagatgattggaattcattaaagagggattatggccacccgggctgaagcctgcgttgtttcttagcctgtcaattattttgatttgatctttaagtacctgtatgttttcttctacttgactagaggtgttaatccagaaacagcgtgtttcatttaaaagtgcacaggtacctcctacttcagctatgaggacacctaaggcctgtctattttgtgctactactgaggtttttagtctgtagattgctgttgtgcctctatgacacttagagttgctttccatccttgttgtatcataatggaaatattaagtactgatctttcaaggagaggggtgcccataaaccagaatagacctctgtctatagaatttctcatccatggtttttctaagatgatgttttcacgtgcatgtcctccccagtctaccctttcagttaaatctccatacaagggcatagaaatgatagatctctttgtccagcatatacaagataatgcagtttccagaaaagaccctaagttagggatgtccccagatgatgctgctgtctcggtagaatttaaaaataacaagttgggaactattgctactatagtacaagttcccttacaaggccttgggaggattaagtttatccaggagccgcaaagaaaatatagccctgttccttgaagggacggttctaagttgtggcttgtgagagacaccggcagatttttctcatatcttagaagtttcccttctttacatataataggggcatccttgggataaggatatccgtctttaggatagtcatttacgatgccgtttggaatttgacatgccaagtgaaaaggatccacctgacaagtggagtttggaaaaatcagagacgtaatatgccctggccagtatctcagatgatcctgtggcaagggctgtcagtccagatgtctccagttcccccacagatctgtaagctgctactatgagcaagcatcatacaagggtctggaattccatgggggaatgtttggaaaggctcatgtgttattttatttattattatttttttttgagacagactctgtctttgttgcccaggctggagtgcagtggcgcgatctcagcttactgcaaagctccgcctcctgggttcacaccattctcctgcctcagcctcccaagtagctaggactacaggcacccgccaccgcacccagctaattttttgtatttttagtggagacggggttttactgtgttagccaggatggtctcgatctcctgaccttgtgatctgcccacctcagcctcccaaagtgctggtattacaggcatgagccaccgcgcccagcctatgtaattctttacattatagtcaacatggtgacttagagcatatcactcccatcgggactttcaaccagaaggagaggctagattctgaaagccccccattagggcttctcatccttttagatcgctcctgttgcgttttcctccccacatctttgaactatcagcagttacaagtgtgatgttacagtatctgagatctcccaagtatggtccttccctactgcttttaaagcagagggagccatttgctattacccgatcaacttttaccagcctgagggtgtgaaatttatctttggggagaatgttgtttggcactgggggaagagtgttctcctgagaggagttagttacccagttaaaagtgcccccatactatgtcccatttatgcctcataaatctttaagggttaaaggtaaagctaacaaagggaatcctacgatgatgagttgtgggtcattgaagggttccttagtgtcattaaactgagcaaaccacttaggacagacccaacaattagtcttgttgtccaaatgggccatggctgatactgcaggagccaaaggatgtgacatattactaagtctgataagaagtcttaacagacttattggtagtaaaacgctcatgtttacttcctgttagtaactgttattcatactaggaggataataattaagcaaagtgctacagtaattgagattctctgtccaatattgtaccctgagggtgctacagtctataatcctactgcaaatagtagaatgtagcaattcctgcaggtgtggcatggtaaataacttccatcaaaaagaaattctaatatttggcaatgaatcttgaaaggagaggtagacacggcaaaaagtatttggtgaggtaggggtgagactgagtaaaatgagtagttcttactcagttacttatcttttgtgactttcagcttaagatctcctatttcttttttacttatatttttaaatttttttttattttgagacagtcttactctgtcacccaggctggagtgcagtggtgtgatcttggctcactgcaacctctgcctcccgggttcaaggaattctctctcagcctcccaagtagctgcttttcaagctgcttttctattagaaaagaaaagtgcagggcacggtggctcatgcctgtaatcccagcactttgggaggccaaggcgggcggattgcctgaggtcaggagttccagaccagtctggccaacatggtgaaaccccgtctctactaaaaatacaaaaaaaattagccaggcttggtcgcgtgtgcctgtaatcccagctactggggaggctgaggcaggggaattgcttgaaccagtgaggtggaggttgcagtgagccgagatcacaccactgcactccagcctgggtgacagagtgagactccatctcaaaaaaaataaaaaagaaatgtttcaggagctgcctttactaaaagaaaaaaaaaaaaaaccttaccgaggactccttaccctaactgcctaaaataatttcttaataactcctgtaatatttcctagagcattattttaggaaaatgatctgttggtgataatttccttaaatttttctgagaatattatcatttactcttcattcctattgagtattttctgttgacatagaattctggattggcaggcttgggttttgtttgtttgtttgtttagcacttgaagtttttttgtacatttcctgatatggtttggatgtttgtcccctccaaatctcatgctgaaatgtgattcccagtgttggaggtagagcccagtagaaggcaattagatcatgggagcagatccctcataaatggcttgtgaccaagcccttggtgatatgcgagttcttgctcagttaacctgaaatctggttgattctgggacctcccacactggctcttttactcctgctcttgccgtgtgatgtgcctgcttccactttgccttctgccatgattgtaagcttcccgaggccctcaacagaagctgaacagatatctgtgctgtgtatacaggctgcagaaccatgagccaattaaactccttttctttataaattacccagtctcagatatttatttacagtgatgcaagaacagcctaacacatttccttttggccttcttggttgcagatgagaaattcattctaatttgaattgtcattgcctgttggtaatttctttttttaagttgctttcaagatgtttactttgtgtttagtttttagtattttgattatgatgtgttataaggtagatttattttgattcattttgtttggggttcacttggattcttgaatctgtatttttgtttttgccaaatttgtaaaaattttattttacaaacaaaatactcaaatgttttattattttatcatcctagaaactcttcctcatctcttaaatactggagtgaaatgaatgtcacctcatttttttcttgtcccacaggttgctgacagtctggttgttgtcatctttttattttttcagtctgttttttctgttgttcttttttttttgagatggagtctcgctctgttgcccaggctggagtgcagtggtgccatctctgcctcccaggttcaagcggttctcctgcctcagcctcccgggtagctgggactacaggcacgtgccaccatgcccggctaattttttatatttttttagtagagacaaggtttcaccatattagccaggatgatcttgatctcctgacctcgtaatctgcccacctcagcctcccaaagtgctgggattacaggtgtgagccaccgcacccggcccttttctgtgttgttcttattgagtaatttctattgctttttcttcaggttcattgattattttttttctttcttatctttattcttttgttgagcccatctagtcagtttttatttgttattgtatttttcagttatataatttgcatttggttcttttatatcttctattactttgctgaaataatctttgtttttttctaatttcttttcaacagcattcataatggttgcttccattgaaacatttttttctgatgactgcttccaaatctttgtcagataattccaatatctgattcctttcggtgttgacatctgttgattgtgttttcttattctagttgggattttcctagctcttgctataataaatgattttaggtagtatctcagacatttgagacattttgttacgagactttggatcgcatttaattggctttgtagtagggagtcaccttggtagcatacaggtcttggcttactttttaaattttggtcagttttacatgtagtcagttcgttgttaagtgtcctatccaggattacatttcaagatttaactatccctttttccatctaccttgtctcctgaatcttcttcctcctgtctgtttgggagacaccacttgctacagctatgtgatgatagcagtggaagtccaggcttcctcttcagcttctcctagtaccaactcaataggggaagccgaacacctcctgctaccaataagcctaagtgaaagttcaggatatgttttctgcttctgcttaacaccaccctagaggagatattatgaagtactactcggtactgtttggaagtgggtataagttcaggcttttcacttgctgcctgctcaaaccaggtggcacatgaaactaggcttcttatttgatttccgtggacactagtagagaagggctcagtttttttcccattgagtttggcattgtcaggtttctgtcctaccacgtacccttatctggtccttttcctagagaaagcaggcttttcttgggctctttcatcagcacctattagcatttctgggtaacagaattctacagtacccagtctgtgatatataggaagtgaaaagaaaatgcaaggtctagagtccagaaataaatccatacatttagtggaagaaagcatagtttcttcaaccaaaggtacattggattcaccttagtagcttttaaaaaagattaatgcttgctctcttccccagacaaatataatcagaatgagagacaggtcagggaggtagactgtatcagtatataaaacatttgcaggcgatttaaatgggggccaacattgagaagctctgtttgaagcacatacttcccatcattgatgagttttttcagatagccatttgacccaattctggccaataagagtctttgtaaggtaacttttacaaggaagcttgttcttttaaacattgtcacatggatatgaatcttggaattgctgtgagcatcttgctaaaggctcacgaatatagccaacacttggaatgcagatgagaaagatggaaagaaacctagtcttaatgtccctcatctgccaaattagcttgcgctggagtcttttgtgcctctgtactttccattatatgaaaaaaaaatgtccttagtgtttcatccataagtttgaattctgactggtacctggaagcttctaaactgctatagctaatgagaagaaaaactagtggtaaaatatattgctattctctaccatatccattttctgttgctataacagaatacctgagactgggtaatttattttaaaaagaggtttattggctaggcgcggtggctcacatctgtaatcccagcactttgggaggctgaggcaggcagatcacctgaggtcaggagttcgagactagcctgaccaatatgatgaaactctggctctactaaaaatacaaaaattagctgggcgtggtggcatgcacctataatgctggctactcaggaggctgagacaggagaatcgcttgaacgtgggaggcggaggttgcagtgagccaagatcagattgtgccattgcactctagcctgggcaacaagagcgaaactccatctcaaaaaaaaaaaaaaaagtttattttggctgggaggtccgggatcagatggccacatctggtctgttctgagggttgcgtgctgtcataacatgacagagaagcagaaggggaagtgggtgcatgtaaaagggatagaactccaggggcagcctcactttataccaacccatttgtggtaattaatctagtactgtgatagtgagaactcactcgctcccttgagaattaaccttgtccctggaatgtgacattaatccttctaaatgacctaatcacctcttaaaggtcctgtctctcaaaatcaccataccagggaccaaattttcaacacatgaattctaggggacaaactcaaaccattgcacatatttttctaatatatgttgtatataaatgtaacgagaataaacttctctagtgaatttattgataggtatagaagtttcctccagtattagcttttgtttgctacttatgttaagatgccagagtagttgatattgttattgcttgttttgtcaaattgctttcccaacagatatctttctaccatgttagcagcaataagtatttcttgtctttattttttatcattggattttattttgggggttgtttgcccatggcatgtcattataatttcccattttctttttttattttaactgaacatgttgatcatttgtctgtttttactcataagttatattttttattggagggggattatctaatcatgccttttgtaccacagtttaacagctttggaacttggggaagttgtatttactctttaatgcctacatgatagaattagtatgaggttaaaatgagatagttttctaaagttctctgagtactttggcaatgaaaatattagcaatcctttatcagtttgctataaataattgttaccatcttcgttccccttttatggcattataatacaaaattatattttaagtaatatttagccaaatatgtcactttccagtcacaatttaaatataagaataaaaggcataacaaaatgatatagatatatgcatgagttaatgtggcaataatataaactaaaaaaatatcgtgatagcctgaaagtgaaaagtattttcaatcaaatgtttctttgtattttcatatttattatatgctctttaaaccagtttgcctaaggtcaggttgttttctaaaagtgctgtgtcacatgtgaagtcttttttctcaaccaagtcattggtatgaaaacagttaccaagttaacccatttatgcctagtgctccattattggcttgctaagcttatgggagttatttatatcctactgctcaaggtcattgccaaggcctgatttttcacacaaaaaacgtttgctacctctggcataaatgggttaatagatgaggacaaaagtcaaccaggttaaaaaatgtgaagaatgtaacctatcaaagttgatttcattcaatttttttttttttttacagaaacatgatcaggggcaagtcttgttggatgtcgtcttcaagcatctagatttgactgagcaggactattttggtttacagttggctgatgattccacagataacccagtaagtgtaagattttgtctttcattttcatttagtttttcctctcagtttagtgtagaaagtcctttctgatttacagtgttcactgatttgatgagttttttttttacttgacttaaatagaggtaattcttttgcttttgttcctcttttcttgacattttaatctttcagaagttattagctttaaggttttcataattatgtcaggtaatgtcactttcattaattatgtgtctcagacaactaaaaagtaaatccaatttatgcctgttgactgaaagagaggaaattgggcataaaggttaaaataccttcagatgtatataaattagtctgcactaaagtaaaattagttttttattgtatttatagagagctatttctaataaaaattcttaatttattcaatgtcaaatttccaaatttcatcagagaccctcacaaataagatagagattaaatttcagagctgtacaattatttggcattaaatttcttggatttttacttattcttcagtaattgcaattgtggttcttttaattagatagatcacatcatagaaatagaagatagcatgtgatgaataatagaaatgtttactttgacaattaagtgttataaaatgcactaaaggatataccttactctgaaccgagataaagggtatacaagcaaattctgattgaattctttgtaaatttatatgcttatacagtgagggacttctgcaataaagtatattcttttgattagtgtaagaggatctccattttgaagggaatattttgtatacttttagaaagattaggaggctgaagaaatggttctggattaatgttttagaaatctgtttataaggctatattaatagaagggctatagaaaatacaaataatgtttatgagaaaagttggtttgtttttttcttcctctctctcatggttgggatcttcattctctgaatgaatagctagtgggaattatatatcaaacgttaaatactaccacttatttttttgacatcatttactgattttgtattacaaaccagtcatggaaaaatacgaggatgacacaaagaaaaacaaaccaagggccagctagtttcagtgaaaataaatgcttttatactgaactaaaattaaaataaactttcctcatactttgatgccttcactagaccacttgagcttcttcaggggcctagagttatactgttgtttcctgataaataaacccatgtaaaaatggaagtgagtagaaatgtcagtaatgcagcctttcccaggttgaacctaaaataatcaaaagggtcagaatgtagtttaaagagagtttattcaagtgcaaaggttgaggacctcagcccaggatacacttgcaagttgccttggagagtgctctggagaacataagaaaggttcaagtttttaaagaataaagaggatcactcaggagagtgagtaagtgcaaaaattgttcttcaggaattctcattgacttacagaaataacattggttagcgattggctatacatggttgaactatagggtgtataacattttatggctacttggcttcagtctgcagcccacatagcaagtagcttcaagaggtaactatgtagctgaagggagagtgagatgtgactgctgttactttttaaatgcctttcttgccctgatcatttaaaggtgctcctattcctcagatataaggtttttttcctttcttaccagaaaggcaaattgtgagccaagcaaatacctgaaaggtgactgttatacctcattaagtatacctcgtgaagagaaaaaatagataattcttagctcttgctgaccctcataagtcaggccctgtagctgtaggctggcattagattgacggggtaagtgacaagatgacaaaagaggaagagaccagtgactcaccactgtagtcactaccataaatatgaaaacagtccttttcaggaagtactccagaaggattaatatcgagatcatgtatactacaagagataaaaattctatcacataaatttgtatacaaaaagacatatcatatacaaaaagatgtagggctaattacaccagaatgaatgtagggaaacaggtatttggagctagattgatctttttgctgtctcctactttttctttctttgtctttctgtcttgagtattccttctcaaataagatacattccaagttccaagagtccagttgtttatgattcaaagtaattcttccagaaaagttagaatcatagaattttaaaggtccaaaagaggctttagagattatctagcctcacactctaatttttcataagacattatcccaatccaaagctacttcctggcattagtgaaactaggacctggatctcctaactccccatgctagtcttgtccactgcactgcagtttcattatttaaatatttggaagaatttctgagatgccaaaatgtgtccacagaaagatctttagagcacaaatcttataaacagtgtcccatttctagttgtcaagagcacaaatcttgtaagtagagttccaattctagttgtcaatgtgaaattaaggctttgaggataattaacggactgaaggaaaaagatgctatgcttcaagagaaaggagtaggggagtatcatttataaaacatctgctgtgaatttgttaatcaactaaataatattccattttattctcacaatactttcctcacttatgatgaaagtgtcattaaaatcattttaaagatgaaaaactaatacttatagaagtcaactaatttgtttaatgtcacgcaaattagtgaagtagctgagaaaggacttgaactcagatctaacttcaaagcctgtactctctaccatatgatgttgcttcccaagtgatgatgatatagatgcataggatttacagagtaaatgaacatattaaggagaggaggtaaccatataataaaattactatcagtgatccaaaggaatttgctaagattctacaagaattaattctcacctatctttagctcataatttttaaatcttaaaacttatgtatgttacatatacatatgcacatgtatgtatatattatgtgtatatgtgtatttttatatattagttttagagaattagaactgttgccttagacattgaaattaatgtaattgagtttataattgataaacttaaaaggcacctagcattttgtttttttctcctaagtatgaaataacaaatacagaataatagctgacggtcttttcctttagaatcttccctggtaatgagttccagtgcaacaaagaaaattacttgaagctttgacttttcagaatttctcctgctttaatttaaagcctgtttatcacagttttagcttttagcataatatcttgttgtagtagtaatagtaaatgtatgttgaataaatgaggaaaataatattgtggttataattcattatgcattatttctttaattttatgagcagtcaaaggtggctttttcttagtggtctttatcagcatgctatttaacagaggcttgagattatattattcctgtgcatttactgtttctttccctattaaattgaattatactgctcttaagtaggatagagggtagattattaattattgttggcctgatctttctgcaggttcattcttctggtagtttttgttggtttatgatatttgactggtttactcctctttgcatagctcctaaccctgtggttttcaaactggagcttgcatgagaaacaactggaaggcttcttaaaatacagatttctgggacctatgcctagagatttctgaatcagaaggtctactttggaactcaagaaattgcctttcaaataagtttccttgtatcactaatgctgctagtccaaggaactatattatgaaaatcactactctaacccagtatgctgttaattaacactactaagttatgacatatttttcttggggtaagtttatttaccctttgaagatttcttttatataactcaattcttacattatttatttcattaggtttgagtaaatatgggaaaagtcacatacaggctgaccgttatttcaacaagccatgtttgaatacatggttgctaaaatgcttaaatctattttatatgtttcactatttctctcttatctattcatatgtttccactgtaatatcttaattcaagctcttatttgcctgttgtgtaatcctctttggtagcctgctaaatgcaattttttgcttcttgtctcgtttaactctgttgtattttgagagggaatggcaaagagacctggggtgcacagaagtgtttaagaaagaagcaggagcatatgcagagatcaagagtgaagaaacaggaatgctgaatttgaagaactggaaaaaagttttagtattaaacctttatttaataaaaggagaaggggtaaaagatgagatttgagcattacatgatatcatgaaaagccttttaatccatgataaaaatcaaacttacctatgaatttatttatatgactaaacacaagacttgtattttacacatatccctgtggttatagtgtagccagcaactaatagacagttgggagattgttggaataaagaaattgctaagaaagtagtggttggctgtggggaatgaagaaaagaagatgagtgctagagataattcagttaggagataaagtcaacaggactggttggtttgattcagatacagtgagttcatgaggaaaaggggtaaatcaaggttactacttcaaattctgcttttggcaacttggtaaatagaaaaaacatgcaaatagtattgttggttttcttttttcatttcaaattgtttatttctagcatatagaaatacagttaagtttgtgtattgattttgtattctgtacccttcctgaactcacttaattctagtagctttttgtaaattctatagaattttgtacctagattatcatgtagatatatggtaaattacattgattttcaatttttaaaccaactttgtgtttctgggataaaccccaagataactaactgattgtatattaaccttgtatcttgagaccttgctaatacacattactgttagtagttgttttcattgattccttaggattttctgtgtaaataatcatgtcttttgtaaatagggacagttttacttcctccttacaagtctttatcctttttgtttttctcattttttaattcattattgcactggccgaagccagcagggcaaagatgaatagaagtgataggcgcagactaccttgtcttgttcctgatcttagaggaaaataccgaagatactgtttccccatcaagtatactgttgagtttttcccctaaatcaatgtaactgaggcataaattacagagaataaaattcagcagccattcataatgaaaacccaactaaacttggaaaagaaaggaacctttttactctgacaaaggacatttaataaatatttaaagatgcatccaggaaatgcaaagtaaaaccacaatgaagtagtacttcctctagaagtagtatacccactagtagtatatccagtgaagtagtatatccactagaataattaaaattaaaaattatttcaataccaaatgttgacaaggatgtggaacaactgataaaattgcttgtggtaatttaaaatgatacaaccactttttgaaaaatagttggaaattttcttgtaaaattaaacatagatttaatatatactgttgggaacaggaccccccaaaatctggccataaactggctccaaaactggccataaacaaaatctctgcagcactgtgacatgttcatgttggccataatgcccacgttggaaggttgtgggtttaccggaatgagggcaaggaacacctggcccacccagggcggaaaaccgcttaaaggcattcttaagtcacaaacaatagcatgagtgatctgtgccttaaggacatgctcctgctgcagttaactaacccaacctattcctttaattcggcccatcccttcgtttcccataagggatacttttagttgatttaatatctatagaaacaatgctaatgactggcttgctgttaataaatacgtgggtaaatctctgttcgaggctctcagctctgaaggctgtgagacccctgatttcccacttcacacctctatatttctgtgtgtgtgtctttaattcctctagcaccactgggttagggtctccccgactgagctggtctcggcatataccactgagaaatcccacttttagctatttatccaagagaaatgaaaacatgtctcataaagccttgtatacaaatgttcacagtagttttattcataatagcccaaatgtgaattaactttaatgtccatcaataaacaaagggatgaaaagtaactgctgtgtatctatagagtagaacactatatggttccatttatattaacttacagaacaagctaaactgacacatagtgaccaaaagcagatcagtggttgcctaggatttggcagactgattgcaaagaagcacaggaaacactttagggtgatagaaatatcttgattgtggatggtggtggttacctggctgtacacatttgtcacaatttaaactgcatattgcaaatgggtgcagttaacctggctggacccacagtctgtattctgtgtccaatttgggagcagtatctctacttatttcttaaaggttcaaactcctctttcttgggactctggagtctaactatacatgcatagttcagctgtcagccagagtttggagctaatcctctttctgagttctccttttcagaatctcctcctcaattttctgtttttcccccacccccattcctaaactctgtcctctgacacctcaagttagtaaggatgtcctctgcctgtgtaggatttgaacttgcccgtaggcaaagattgctaatatatatctcagcccttgcagtttttgtttttcaagagtagactttcctcctctttctgcctacttttggttgctttccagtgtcaaatagtacactcatgaacacacagagaataaaaatgaatgccatcagcagacaagaaattttcaagattttttaaaagatcgaatgttgacattcagtgttgacaggattggtggaagagtcaaaccagaggaaaacttaccaaaaaggtgttgaagaggaaagatttctgggtaatgtagtacgggtatcaaagtgattaactgagaaactatttgaggccacttggcctcctcttttccccatttctaattgaacagagggcagcagatacagttccctgcagaataaagctgtgtgttagggtatgtttgttgggggaagaactcatttttctttagcaatatgattatccaccttgaaagctcaaatgaatcatttggaaaactattataactggtaagacttagagctcaacaaacatcagtacctttttatataccatttaggagacatacaccaaaaaatagcaaatcacgttttttttaaaacccagattcattaaacatctaggaataaacttaagcaggagtgtcaagagccatatgaagaaaatatagaactatgcaggaagatataatagaaattatgaataaatagagacacaccatgctcataatgaggaatgctcagtattgtaaaagatgtcagcactatttcagtttcattggtaaaaccagtggtattgctggttagtatctgaatggaatttttggggagaagatttgacaataggatcctcaacttcctctggaagagaatctggataaacttagccagatatataaaatataatcaactcgtcctaacaggtataaaaatggaatatgatgacatagtacttaaaatagtgtgttcttagtatcgatataagtcaatggggtagaagaaacagcccaagtatcaatttttgtctatatgaaacatagtttattataatgatggtattcaagataggtattggaacaattggttaaagatgagaaaatatgtatttagattcctaacagataccatatataaaaataaattccaatgtaaatttaaatgtaaaacaatagtatagttgggtaagagttggaaacatttttaataatatttgttatgatcatcctaggcaacaatagttcctgcatttgtaaaggaaatgttgatagatttcactgcataacatacagagtatacactgaggacaaaataccaactggagggaaatacttgcaacatatgtaacataatattaaaatctagaagagcttctacaaataataaataaaagtcacataacccaatagaaaaatgggaagatagcatgaacagaagaagagtaactattaataacaaacgtgacaagatattcagcttcactggttaatcagagagatgccaattacaatgataacactctttgcatactagattagcaaaaatacagattcacactacctgtttctggcaaaggctcgggaaatgtgcattctcaagacagttggtgagagtgtaaagtgaaaaagtgtttttggaaggcagatggcagcatatatcaaaatttaaaaattattgtatggaagaatttctcttgcaacactatttttaataggaaatagtaatggaaaaacctgaaaccctcataagagaatagttgaataaagtatgtgacatctgctgggcatggtggtgcatgcctgcagtcccagctaccggggaggctgaggcaggagaaccacttgcgctcaggagttctggactatagtgcactatgctgattgggtgtctgcactaagttcagcatctaacattattaaatgcttgtatgcaggtgtaccacagcattataaggtatacttgctggtatgtgaacagaggctacctctttggatggaagagtagaattggaagagccataataaaggacttttatgtttttttgctctgtatgtgtgtgagaaagagagagagaaaaaaaaagcttgaatgttttatattgatactgttattttagtaataattttattatagaaaacaaaaggataaacgatcattcatctaaacttggctatgcttccaaattccttgggaaacataaaaaaattgctgacaccctatgcctacagattcatggttagttggtctattcacctaaatatctgaagaaagtccctttgcgagtctgatactcattgactcattcatagtcacccatttggttaaatcacctgattttataataaaatgatgaaagacttgagaggtgaaaggggagctgtagtgggaaaatattcagacgaggatttattgaaccccactagttctccagtattgtttttaattttattaaattttgttttaattttatttagccattgtttttgttattaattttattttatttagcgtagtgaaaggtaaagttgggatcaaatccaagttttccacaccttttctttctactgttttactaaaccctatgttttttactggatctagtgactctccagaattactttatttgggagatgctcttcctcccaagtttctaacttaatttctagtaagaaataggattgatttataagagaaacaaaaggttaatatcacaatgtatacagctaccattaagatgagtaatggcaggtattacagctaaagatttctaaaaatggatagaaaatggaatattttacagatgaaataggcagtacttgatctttgctatcttgggcataaatactttctcttcctgaaatatcttacctttaactcacatccttcactcccgtcacatcttttaccctacccctcttaccttcacattttttaagactcagagtaaaagtcactttccctctcaagcctttcctgactaccactactccccaggtacagtttacctctttcttttttatctgtagcagtgatgatactttcttgaggtgatatgtttcatgacttaccagtttttgaggatagggaccatgttttgaacttatatcaccccagtacctgacacagtgccttatagaaaataggcttcaaataatgaatgagttaagggaaaaaagtatacatctaaaacttgatactgtggaaaagaatataagctagaatttaatctccaaagtgatactgaaacagatgaagaaataaatatatggctgtaatttgtccaaattatattttctttaagaccaaggctatttacaataggaaccctgaacagtttggagttaaattactttattgattgattgaaacaaggtcttgctctgtcacccagactggagtgcagtgtgcagtggtgcgatcatggcttacagcagcctcagcctctcagactgaacctcaacctcctagcctcccgagtaaccaggactataggcatgcactaccacatctggctaattttttctgggttttttttttttgttgttgttgttgttttttttgtagagacgtggtcttgccatgtatctttcccctaatttgcagaaagatacagatatgcaaatagaagaagctcactgaactccaagtacaatgaaaatggtcgaaagagttttgaaagcagcaagagaaagagaaaagtgacttgtcacatagaagtgcacctcaatgaaataaccagtggatttcttagtagaaaccatgcagatctcaaatgtagaaattttattactacgttttggcagatacaaaaattaactttgtcatgtgaagcagtatatagagtaaacaagagattcttcccagggaaaagaatgggaaattggctttgaaaagattagaaaccatgagtcatcaggtaaccgattagcaatgtctaatcgctttgaaaggtttgaaaagattagaaacagagctccatccctaagtagacactccttcatgaatggggttgatgatgtagtaccgtctcttgttagctatcagtgttaactagatagttatagtttctaataaaatattaggacatttaaaattcatatatattgtattgcagacagttcagcttttctcagatgtagcacagtaatccagctagtacagcagttcttggcaaagaaaatgcagtctgtaactaaatataggtagtgatataaccccaatgctcatttatataagaacaaaattaagggtttatcatatgtgatttcaagatgtattaaaacagttactttaagcagttccactcccagatatatattgaagagacttgaaaatgtatgtccacacaaaaatttatacacagatgttcatagcaacattattcataataactaaaatatgggaacaatccaaatgtccatcaagtgatgactagataaaccaaatatggtatagctatacaatgaaatattcagcaataaaaaggaatggcataccacagcacactcattgggatggctataattttttaaagatagtgttgatgaggaagtgaagaaatggaaatctttatacattgatattggagatgtaaaaggtacagccattgtggaaacaagtttggcagtttctcaaaaagttaaatatacaattatcctgtgacccaacaatactactcctaggcatgtacccaagagaattgaagacatgtgttcacacaaaaatgtgtacacaaatgttcatagcagtattattcataatagtcgaaaagtagacacaacccagtatcagccataaaaaggaatgagttattgttacatgccacaatgtagatgaaccaagaaaaccttgtctgtgaaagcagacaaacacaaaaggcaacctgttgtatgattccattcttacgaaatgttcaaaacaggtaaatttgtagagacagaatgtaggttagtgattgttaggggcaacagggaagggtacattgagactgactgcgaataggtacaagattacctttgagggtgatggaaatattctggaattagatagtgatgatggttgcacaccgtagggaatatactaaagtataatgacacatacatgttaaaatggtaaattttgtggtgcgtgaaatatgtctcactaaaaataataaaaataatgctgagtcttggcatatgcattttataatttgataaattttgccaagttatcctccattgagatggtacaatttatactttcagaagctatgtatgagagtgcctgttcttctcacgtgtgtgtcatcaaacgttttagtctttgcccaatattactgttgaaaaataataacccaatgtagattacttttgtatttctctaattatgatcaagattgactatcttgtcatatacttaaatgccatttgtagttccttgattgtgaacttgcattcttattcattgcctgtttttctattagtgtcagttttttcttattgatgtgtagaacttgtttatatattatgttttttcctagtttgttttgcaacttgatggatttttacaatgaatgctatttttaccattcagtagtgcttgttatagcactgttccatcttcctggtttaaaccaagaaccttaaccctatctcactgatatcattgatgagagcaattaaatttctcagtgcttatctttgtacttctaagctatgtcagcttgacacatctgtgtatgtaaatgtgtttgtatttcttttaccagaatattttgaaggagaactgaatgaggaagacaagctttcaatagattaattgatctgaaattttgattgtagacagtcattaaagtggatataatttatgacttttcctagaagatatgaagaacaaaaatcactagattaatagatagatggatgggaaggtggataaatggtagatgattgaggaaagaagtttattaaacagggctgaaaaccctacccccagctattgagtcattcagcaggtttagtccttcagtaaattatttatttatttatttacttatttactttgcttactttcttattttgagacaggggattacaggtgtgtgccactgcttttgacagtatttttaactcatattatgtcaagccctgtgctaggtgctgactctacagtattgactgaaacagcttttatccctggtttcattataatctaatgaaggagtcagacaaaaaaagacaaaaggtgaaacaaacttaattgaggtaatgtaatgaagggatataatgttccttacttgttaaatgggagctgtacgacatacttttggtagggtggtcagttgaaggcctttctgaggtggcaggctttaagctgagacttacggataatgaagagtactgtaggaaatctagagggcattctgtgaaagggaagcttgaaattgagggccttatgatggcatctttcagaaacagaaaggaggccattatggctggaatttagtaagctgaggtggaagaggtaagaagagaccatacaagctgtagtgtaaggactttggatctagtactgagaaattatcaagaagtgttaatcaaatgagtgacatactcaaagttatgttttaggactattcttgcttctttatggagcatgaagagggacatggtgatgagaaaatcaactgggagagcaattaagaggcgatagagcttagactagagagataaggatgataaattgataaattctagatacagtttgcagatagactcagttggatttgatgtgttggatgttatggacagtggagaggaaatcattgttaattactcccagccatttatttattattaaaaatctatgtgttctgcctggatttaattatgggtggtagaagttaggtttataaataatgatacataaacttacttggaaaatactaccacatctagtacctcattttgggttctttgatttttttttaattgaaacatgttagcagttgaagtttttctgaattcagtcctaattgtccagaaatagagctaaactggccttcagaagtattgaaactgcttaaaatttctcacacataaaaatcaatcattctcaaaactaaacattatatctttaaaaattggtgggtttttttcaaatgggaggtattttatttttaaaggaatgaggcaaatgttataaaatttctcctcagtggattttcaagttctgtagtagaattttgcctgaatgagtataaagcccaagagcatgtgtgtgtgtgtgtgtgtgtgtgtgtgtgtgtgtgtgtgtgtgcgtgaagggtgaagagaattttgaaaacttgccagacttttaagaaatatagttagattaatgtgaatcacttcacattcacttcaggttgctgcaattattaactatctttacttatgaaatagaggttgttgcacattgtactgtttgatggaaaagtcaaatcaaaatcttaatattaacacattcactaatttctagcataattttattacatttgatatgaaaaatattgtctgtaatgcaatgatttttttcctacctgggccttttctgaaatgcagcttttagcattaatctccaaatggaacagatttgcaagaatcaatatagtagttcctcaaggaaaaaagaaatcagttttatttatttatttttcagaggtggctggatccaaacaaaccaataaggaagcagctaaagagtgagcatacatatttacttaatgttttgcaagtttactttataaagataaaggattaatatagtctgattaattagaactacttttattaattctaggaggatctccttacagtttgaactttagagtcaaattttttgtaagtgaccccaacaagttacaagaagaatatacaaggtgggtttatggatatatttttcttgaaaatattgtcaaaactctaatatgaaattttgaaattaattaggcaaaaagaaattactgtggtgtaattctgagctttccagtcagtacacagaataagttatggctattccaagataacgttttcctccttttttggatggctgggagagtgtaaggggatttagaacctcagggctgcccagtccagccccagcttcctgaaccatgtaaatattaaaaatttctacttgtgaacactgcttaagtgtggctataattaattgaggtcatcaaatgtgctgaaattgtatccaaaggatgctgtgtggtgagaaatttgggttttttttttcccatgtgaaagcatattctagtatctttttttattggggagaacatagaatttataaaatatataaccattatttgcgggtcagtaggtaccttttgtcccctatgtgtttttaatctttggttccaaaaaaatataatggagtttataaaggatgttgcagagagtgcactagcatgttgaggcctttacatgcccacttgactctccattttaagtctcagcttatgttactatctaattttatggtcatttcgacttgacagagtatatacacatgaatgatccagatgaacattttgataatgttcttgattatagggtgaaatattgaaggtagaaatggagaaataccaacagtgtagtaactgtcagtattaacctgaatgacaaccttgtgtgttgcctgaaagacagaattagtaatgagttattttacaaagacagttaaaaattagcatgttatactctctgtaaaattctcagatataagaatataggccagtgactacattcagaattactctaaaagataggtgtcaaaattaaaaaatccatacctaaaattacctatagatgggatgttaaattttaatgtattggttatcatttaggatactgtcttggagtagagaaacaaaaggataaattatttaattagctgcagctgccagttctaaggtgtttgcagagttttcagtagtaaaccaagtgagaaaaattagattgaaattctagagatttcttttcagtcagtgtgttttggggtgggtgcgcaggtgttcctttttttttttttttttttaacaaatgggagaactcagtaatgtagtctctggattatgtaatcctaatgcttgcaactattagtagaatccaagctaattcctcttgaaaaactaagttgtggccgggtgcagtggctcacgcctgtaatcccagcactttgggaggccaaggtgggcggatcacgaggtcaggagatcaagaacatcctggctaacacggtgaaaccccatctctactaaaaatacaaaaaattagccgggtgtggtggcaggcgcctgtagtcccagctactggggaggctgaggcaggagaatggcatgaacccgggaggcagagctggcagtgagccgagatcacgccactgcactccagcctgggcgacagagtgagactccgtctgaaaaaaaaaaaaaacaaaaatgaaaaacaaagtcgtgttatatgtatacaccttagcttaatattgtagcccttaaaatattgtcagttaaaactatgtttataatgtacttcacttgaaaaactgtctttgaatttctgaatggaggtagaatgtgttgattcttttatagcctgcattgaaaacataataaggaaataaatatgtttcactaataagttgaaataactgcctgaagcagaagaaagtaaaatcaagtttgatggtagtcaaggaattaatttgctctcagacccttttataatggaatgttatggaatcttataactggtattgtttggtaaaatggggtaaatgtctagttttttgtaaattttactaccatagtgtatatcagtgatttttctactctgattagaaattagaatcatttgggggagctttaaaaccataatgatgtcttggccacatccctagataattctgattgaacaggtcttagatgggacctgagcataggcatgcacaagttcccccaaatgattctaatatatagccaaggctacatattagccaaagctttaatgcttgagtagccttaatgtgatggttatgattagtaacagtgcaccttctgccacagctgctaagttttcagaactagtttagaccccaggaaacaggaaatctgctgcacctccttaccttgagatttcaagaatgtaaatagtatattcccaatatgcagatgaatctgctcagtaattctttctcagtttttagctatatgaaagttgactctgtttggtagtgagccaagaggagaaaataaactctatgtaatactaaattaatttttaaaatatccctttaactaatgaattagtttagtttaattagtgaaaaatattcctttaattttgaaattatgggggggtggggggcgggaaagaatggagtcaaacaggttcaccaggttaaacaccgtttacttttagcaggtgctagcatcattagaactgaatttttccaattcctgagatacatatactaggcaagttgatactactttcttcttacaaatgtagaaactaaggctcagccacattttaactaatttgcccaagatcacaggctagttttgcctaggacttgaattctggtttctacttttaacagttaagttcttgcctcttggttaaatgagtatgtaagtaaaatttggcaagtataggcattatttatgtcagatttacaatattatggcaaggatatgcatgacctttaaatcctgactataagattgtttcttaccaggaacctttaactttgaatttttttttttttctttttttgagatagagtctcactctgtcgcctaggctggagtgcagtggcgcgatctcggctcattgcaagctctgcctcccaggttcacgccattctcctgccttggcctcccgagtagctgggactacaggtgcctgccatcacgcctggctaatttttttttttttgtatttttagtagagatggggtttcaccgtgttagccaggaaggatggtctcgatctcctgaccttgtgatctgcccgcctcggcctcccagataactttgaattattaaaccaaaacaggcctgatagaaatatactgtcttggattgagtaaatagattatatttataatattatgcactaagcctcacaagaagttatatatgaagccaggatgtttgtattctttttttttgtaatgaatatctgattctctgaaaacctctttggtaatttgaatattgtcatggagctcttcagtgacttaatcagccaaactagaatttctaatgacttttgactcttggaatatgtactttttttagtttagtgaaataaaaaatcttaagatttcctggttaaacatttaaaaccaaaaagtttggtcttctgccacccctatacaacacaggtgactttgcccaagtattgacaaatctttgagtgggttacccactagcagagaccaaaggacaatgctatcttgtaagcaatgacagcaggcttgttaaagaaaacctaagtttttgttggtttcacaggaaattgaatacttgacaattctaacaatagtagacaaaagtattcttcccctgccccgccaatcaaagagagacttccttaattcacatggaagtgtataggtgcttttctgtaacaggcagcttcctgccatctgatgataaaatgatcaaaacgctggcctgtccttgtagctggctttctatctcagaccagcgaaaatcatcgctggtctctagtgcattgcttacaatgctcttccatgtttgtgatactcaggttttctatgcttcccacttctttctgcatataccaaccctcaagagtatttctccctctgtcatgtaactatttgaaatcttgagggcttctataatggaagctagtggaaacaagacattcgaaatacaaatttcatacatcaaagagttttaaagatttagattcatgagcttatgaaatcttatttttaaactactttacatgttttaatatgtaaattataaaagcaaatatttaaatatgtttatttgttaatgtaagtatacagtttcttagaattgaaattgttacaattctattaaatgctatcctttttgtttgtttgtttttaaggtaccagtattttttgcaaattaaacaagacattcttactggaaggtgggctctttaaatttcttaaaaaattttttgtaatggactttaaaaatactttttaaatctgtgttaagtaattcatggtcattgcaaacaaattatttaagaaggttacatgtagtgtgaattcctttcatcagataagtttatttcttaacagttaaaatcaaatcacatgaaacttcaagtgtgattgtttaacaaattatagcacttttgaaattgctatgtttaaccttcggttgtgtatttttgttttgttttattagattaccctgtccttctaatactgctgcccttttagcttcatttgctgttcagtgtaagtatcagcccatttttaggtcaaatagcatataactgtggtttgtgttgctagtacattggcttcaatgtgggagttctttagaaatgttgctatatagaaaatagtgactgcagtggaaatgtaatgaaatctccagttagttagcaattactatgatttttgaaaaaatttcctctgaaattgagaccaagaagaatgttaaatggattgctgtggcttgcttaagtggttatattagaaacataagtattttacatccagaaatagaattaatggcatcgctgatttgactataataatttaaaaatttgtttattaaaatgtgaatgttttcctttcattattagctgaacttggagactacgatcagtcagagaacttgtcaggctacctctcagattattctttcattcctaatcaacctcaagattttgaaaaagaaattgcaaaattacatcagcaacacatgtaagagttttttagttttttatttgataaacttcttaatggcattctttctagagaaatgtttgaaattctaatatgatggctgtatttaatatagaacaattactgttacctaaaataatattatcataaagaaatataggtgatctatgctaaaaaacgatttcatagaatatatgaagctcattttcatttctattcagagccattaagctatctgtaaacagatatttatttgctattgtgtaatagtctaaataattttagaatataaacagtatagtcacaatatagagatcagtctgcttagtaattctttctcagtttttaggtataaaggacttgattctccttggtagtgagccaagaggagaacaggaactctatataatactgaattaatttttaaaaaatatttctttaagaacagtacaggttgaacatccttaacccaagagtttgaaattcagagagctctaaaatttaaaactttttgagcactgacattacaccacagtgggaaattctgcacctgatcccatgtaatgggtttcagtcaacattcggtgaaaactttgtttcatacacagaattattttaaatattatataatattaccttcaggctatgtgtataaagtgtatatgaaacataaatttcatgtttagacttggtttctataccaagatattgcattaagtatatgcaaatatttcaaaacttgaaaaaatctgaaatctgaaacacttacgatcccaagcatttcagataagagatacttaaccttatcaatattcattcattaacaatattcattcaactttgatttttttgtgtgagtataattttatatattattttttcaaaagagatttgttgccttgaatagaaagtaatattgtttattggttcagaattcagttgtgcttcaatatacaattcagaatactcagggaaaaactaaggcagtgttgcgtattggctaagagtctgaactaaagagccagactgcctggtttgaaattctgtaagattacttactatcttataaccttggccaaactgttttatgcctcttcttctctgtttccttacgtaaactggggataataaaagtatctatctctggagttactgtaggtcttaaatgagtttatatacataaggttctcaaaaccatacatagcacattgtaggcactgaagaaatgttagctgttgttattattaagaaaacttactttcttttactaataactcatgtatctaaaacaggataacaaaccatggccattgaaacggagtctcgctctgttgcccaggctggagtgcagtggcgcgatctcagctcactgcaagctccgcctcccgggttcatgccattctcctgcctcagcctcccggtagccaggactacaggtgcccgccaccatgcctggctaattttttgtatttttaatagagatggggtttcaccgtgttagccaggatggtcttgatctcctgacctcgtgatccgcctgccttggcctcccaaagtgctgggattacaggcgtgagccaccacgcccagcccctattgcctatttttatatggcccacaggctaagattgttatgtagattttaagtggttgcagaaaatcaaaagaagaatagcattttgtggcatgtgaaattttgtgaaattcagtgttcatgaataaaacacttactggaacacagataccctcattcatttatatgttgtctatggctgttttcgcacaatggccaagctaaatagttgccacagagactgtatgtcctaaaagcctacaatatttactgtccagccctttgcaataaaaggtttgctgattcctgatctaaaatagactaatgactgagtttttaatggactacctaatgtggtgagggggctattttaatctaagtaaattccattcatagtgaaagttatacatacagcatatcagaatcaagagtttgaagataagccagatttttttaaatttaccgataatgaaaagactcttaaggaaaagcttattgattatatatatctatttggtttaagtaaatgattcatcagatctttaaatgaagaaaaacagaagtatccactttaactggagggagtatatatttaatttaattttatagaaattggaagtgtactgttttttttgaggagtcgtgttatgatcatgcattagcgggctgttggctcccttttctagtagcattagtgaatagaaagtttgtatctttgtttttgtaatttgctgcttttgctctgctgtagtctgataataacagataactaaggttgtaaaaactatatgtgaaataggagtaaatctatttttaaaggccttacatttagagcaatggttcttcaacttgtgtttataagaatcacttggtattcttgttaaatataaacagttttgacctcatcctttctaaatcagactctacagaatagtcttcttaaaccatctgtgatgaaagatgatttcttccccccagctgtcattattgtgttacttatattttgtagaatataataaaaattaattactagaaaaataaagtggagaaagaaaacaaagacgtaaaaaatacaagtcctcatttgtttgtttttttgttttgtttttttgctgttagatttaacagatattacccaggcagattgctatacaagcctccaacactcaggttccatactgtgaatcaacctctgtctgtgcaccacactctgagaagcactgccctggaggttggcttagaatctgcaagtttcagagatatcctgtgtgatttaaatgcagatatggtatatgaaccaaattttgagaaatactgcttttaagttatatctaaaagtgaggggttttgttacagtcacccatataaatagtgaggagctttaaaaacttggtgtattcttgtatttctagaaaataagacagtattctggaaaataataatttgggttactgaaaatgtgccctccagataagttagaggagtagtcctgcatggtgtttcatagatttaattagactgctcagttttttcagataaatagcctttttctaatttagccatatttatttgattgattgattgatctcatttttaacttaatgatgtctttatagaggcttatctcctgcagaagcagaatttaattacctaaacacagcacgtaccttagaactctatggagttgaattccactatgcaagggtaagtgaagaaaacttactttgatgttgttgagttaggctccgttactcaatataacattttttaagattagataacaaatggaataagttatgattgctgctgacacagctgcactgaaaatttcctctgaatttaagtattttcacaataacttaagattcaattcccgaatgtgaaggatggttaatgtggattcttcaaggtagtgttttatatgtaaagataatttttacagaccgtaagatatagtacctttagaatatttattttaaaatataattgttaggctataggaaaagtggcttttgtatacttttataataatgatcattaaaaatgttctcacatcactgaggcctgtattagtgcacttactttgttttcatcatttaaaagcactattacgagtttttatttataaagcacaacatggagcatattaacatttttatctccccccatccctgtagtgaagtggaatttatagtcactgactttttctatattataccgtgtgacttcttttcccttgtgtcaaacattgctgcctttgaaaaactggtaacctcctggcataagcatatttgtgagtgtttatcctgtatttgtgtgtttcctcatgtttttcttgagttctctatcaaaagttcttggagtacagctattctatacccagtgaaaagtggaattataatcatcagttgagttggtgatagcgtttatcttctcttggaaatgaatagttgagcctaaaaaggatatcaacctgaaagagaattcagagccaatatttttcttagataattattttcaatcatgttaatactcagacactcacaggtacacagatagttgttgaagtactcaaagttctacttcatgtaatggttttatcctttaggaccttacctgaccatgttctgggagaggaacattagttcttatgtttcacaaagcttatgtcaatctttcctttaaaagaccagatgaattgctttcctcacatgattttatcttgtaattctgagtgttacttggaaatctttttgtctgattccatttaaaatgtgtctcttagaaaccttcagctttctttttttttttccttcaacttttattttaagttcaactttctgctttctttaaaatatgcccctttattttccttccttatttagggcctatatcttttgaacatgattcttaaaaatgtaatgtactggtcagtatttgtgtaactagtttgttttttattataataaagtttaaaacagatggaactttaaatatatgaattaaactatggttaaaaataaaaaggggctgggcataatgtatcatgcctataatccgaacaccttgggatggcgaggcaggaggattgtgtaagcccaggtgttcaagaccagcctgggaaacataatgagatcacatctctacaaatttaaaaaatgacctgggcatggtggtgcatgcctgtagtcccagctactcaggaggctgaggcaggaggatcagctgagcccaggagtctaaggcttctgtaagctatgatcatgccacttcactccagctggggtgtcagcaagatcctgtcctttcttctagtatttttatagtttcgggtattacactttagtctttcattgtcttgagttgatttttgtatatggtaagagctagatgtccagttttcttcctctgtatgtggctatctgattttctcagaaccgtttattgcagagaatgtcctttccccaatgtaagttcttgttgactttgttgaagatcagttggctgtaaatatttggctttgtttctgggttctctagtctgtcctattggtctgtgtgtatgtttttatatcagtaccatgctgttttggttactgtagccttgtaatatattttgacatcaggtaatttgatgctttgttctttttgctccggattgctttggctatttgagctcttttttgtttctatattaattttaggattgttttttctaattctatgaagaacgatgttggtattttgatagggattgcactggatctgtagagtgctctggcaatatggtcattttaacaatattagttcttcagatccaaaggcatgggattttttctatttgtttgtgtcatcttaaatttttcatcagtgttttgtagttttccttgtagagatcattcaccttcttggttaaatttattcctaggtattttttgtagctattgtaaatgggattgccttcttgatttctttctcagctagatcattattgatgtatagaagtgctgctgatttttaatgtgttgatttttactgaatttatttatgaaatctaagcatttttggtggagtctttaggttttttttagatataagatcatatcatcagcaaaaagaggccatttgacttcctctttcccaatttggataccttttccttctttctcttgcctgagtgttctggctaggacttccactactatgttgaataagagtgtgaaagtgggcatccttgtctttttccagttcttagggggaacaatttcaacttttctgtgttcagtatgatgttgactttgggtttgtcatatatggcttttattattttgaggtatgttccttttgtgcatttgttgagatgttgaagtttttcaaatgcttttacaatgtcttttgagatggttatatggtttttattcttcattctgttcttgtgatatatcatgtttattgatttgtgtgtgttgaactatccttacattcctgatataatgtattgtatctgattgtggtgtattatctttctaacatgctgttggatttggtttgctagtactttgttcaagatgttggtgtctgtgttcactagggatattggcctgtagttttcttttttctagtttttgcatctttgtctggttttggtatgatgctaatgctgaccttatagaatgagtcaggagaattccctcctcttcagttttttttggaatagtttcaggaatgttattacttctttgtgtgtttggtaacattcagctttgaatccatctggtcctgggcgtttctgtgttgggagactttctttactgatttcaatatcactacacattattggtctcttcaggttttctatttcttcttgattcagtcgtggtaggttatatgtttccaggaattcatttcctctaggtttcccagtttgtcagcttgtagttgttcgtaatagtctctgatgggctgggcacagtggctcatgcctgtaatcccagcactttgggaggccaagacgggcggatcacgaggtcaggagattgagaccatcctggctaacgcggtgaaaccccgtctctactaaaaatacaaaaaaattagccggtcgtggtggtgggcacctgtagtccccactactcgggaggctgaggcaggagaatggtgtgaaccctggaggcggagcttgcagtgagccgagatggcgccactgcactccagcctgggcgacagagagagactctgtctcaaaaagaaaaaaaaagtcttgatgatctttcgtatttctgtagtatcagttgcagtgtctccttttcatttctgattttacttatttgggtgttctgtcttcttggttagtctagcagtttattaattttctttatctttttgaagaaccaactttttgtttcatttatccatcattttttttatgatcactatttcatttatttctgctctgatctttgttatttctgttctattaattttaggtttgttttgttcttgctattccaggtttttgagatgcattgttagactgttaacttgtaatctttctcctttttttgtgtaggcatttattgctgtaaacattcctcttatcagtgcctttgttgtatcccacaggttttgctatgttgtattccattttcatttgtttcaaagaatttttttatttccatcttaatttcttaattgacccaatggtcatttagaagcatgttgtttaactaatttgttgagacttgttttgtggccaaacatatggcctatcttggaagatgttccatgtgcttatgaaaataatgcatattctgcattgttcagtggaatgttctgtaagtgtctgtttggtccatttgatctaatgttcagtttaagtccaatgtttctttattttttttctagatttgtctaatgctgagagtgaggtgttagtcccctactattattgtattgcagtctgtgtctctctttagatccagtaatatttgttttatgaatctgggtactccaatgtttggtgcatatatatttagaatagttatgtcctcttactgggttgatctctttgtcattatataatgaccttctttgtcttttttttttaactgttcttgaaataattaaaatctgttttatctgataaaagctgaggtactcctaacttctcattttcatttgtatggagtatttttttccatccctttattttcagtctatatgtgtttttaatgaaaaagtgagtgtcttttaagcaacatatagttgaattatgtattttaatccattcagccattttgtatcttttaagaggagaatttgatctatttacattcaaagttattggtatgtgaggttttgttcttttcatattgttaattgttttctggttattatatgtattctgtgtttctttctttttctcttataggttgttgttttgatgggtttctgtagtgatactgtttgagtcctttctcttcctcctttatatttctttacccattaagttttatacttttgtgtgttttcatgatggtaaatgtcatcattttacttccaagtttaggactttcttgagcatatcttacagaactgatctagtggtatagaattcccacaggatttatttgtctgtgaatgatttcatttccctttcatttataagtgataattttgatggatatagtattctggagtggcaggttttttctttcagcactttcagtatatcattctattgtcttccggcctataaaatttctgctgagaaattcactgttagactggtgggattttctttataggtgatgagacacttctgctatttttaggatttgttcctgaagtttcactttagacagtctgattataatgttccatgcagaacacctctttacattattatctgcttgggggtacaagtaacatgtaaatttggtcaccttatcttgcctcaaatttcaggaaggctttgctcattcttttttcatctcttttctttatttttgtttgactggattattctgaaagacctgtcttcaagttccaagattcattcttcagactgatgtaggctattgttgaagttttcaaatgtattttgaatttttttcagtgaattctacagtttcagttttttgtttgtttgtttgtttgtttttgagacggagtcttgctctgttgcccaggttggagtgcagtcgtgtgatctcaggtcactgcaacctctgcctcccagattcaagtgattctcgtgcctcagcctccccagtagctgggattactggcgcacgccaccatgcctggctaatttttttttatttttagtagagatggggtttcaccacgttggacaggctggtctcgaactcctgacctcaggtgatccacccaccttggcctcccaaaatgtgggattacaggcatgaaacagcttcagaatttttattaggttctttaaaaaaatatctctttggtaaatttctcattcatatcctgaatagttttcctgacttatttgtattgtttttcagaattctcttgggtctcacagacctttcaagtcaataatttgaattctttatttcatgctgggattttgaacttttctttttgattaagatctattgctggagaattattgtattcctttggagataccatattttcttgctatttcatgtttcctgtgtgcttacattgtatctgtgcaatagttgctgctgcttatatttgaatttgcttttgtaggggaggactttttcctgaagatttatctgtggtttgggttgagtagggtacatagacttcgattctggctgcatgcagtaatatggtctcatttatagatatcgtagacatagcagtgagtaaagtagataaaactgaaccctcccaaagcttgcattctgtggggcaagaaacaaaactataaatgaacaattatgggtatatcagagtatgtactatttgattccattgaagttcagtaactagcaaaataccagcctatattgatagaagtcagaatagcagtcagttctggaggaatgtttattaactgggagactcatgagggagctttctggatttttcaaaatgttctatatattggtttgtgatggttatgttggagtgtaaataggtacgtgtatgtatgtgtgtaaaattttgagttgtacatttaagaaatgtgcattttactatacagtacttcagttcttttaaaaaattaagcaggtcatacatcagatattgatagatgctatgaagaaaagttaagctgagaaaggggaattaagacaaacaaatgagggatcagggaaggtctcactgagaaggtaaacagatctgaaagagccatgcaaacatctgggaggagattattctaagcagaggaaagagcaatgaaatagtgtatatagcagttcaaataatagctaagagtttagtgtggcttgtgtagtgcgaacaaggagaggagagtattagggcatgagatcaaagcagacaagaacttttaagactttttttttttttccttctttctttctttcttttgaggcagagtcttgctctgtcatccaggctggagtgcattggtgcaatctcagcttactgcagccttggtctcttgggtccaagtgatcctcccacctcagccttccatgtagctgggaccacaggcatgtgtcaccatgctggttgaattttttttttttttttttaagtggagatggagtcttgctatgttgctcaggctgatctcaaacttctcagctcaagcaatcctacctgcctcggcctcccaaagtgctgggactgcagacatgagccaccacatctttataaaacattttaaggactttggcttttaattataatcaaaaccattagagagttttgaggcaataaaagacatgttgtgaatttacatttttaaaatataacaatgacttttgttttgagagtatactataagatactaagggaagagactgttggagtgatccaggtgaaaggtaatggttcttgtagtattggggtggtggacagtaatcagattttgaatatattttgaatatggaagtgacagcttttactcatgtgtactggctatgggtgtgagagaaaaaggatttggtaattattccaaagcttttggcctgaacttttactaagttgggaaagacctgggagaagtagatttagtagaagcataagtcaagaatttatcttgggacatgttaaatttgaagagacgtaaatcctcacgaaagaggggtaggcaattcaatttatagacctggagttgagaggaaaagtctggactagaaataatacatttgggaattgttagcgtatagttaatagttaaaatcatgagatgagagcactgaggaagtaaatttagtagatgttgaagagaacaggtcctcaaagttagaacacttcaatgtttagaatttgaagagatgaagaagaaccaggaaagagaaccaagaaggagcagccattcagaaaggagagcctttctttctatcaaagacacaaatgtgtgtctctgaagccaagtaaatcaggagcagtcagctttgtcagatgatgctgttaggtcaaataaaatgaggacagagaactggattagaaaagtggaggtcactggtgacttttcaagagcagttttggaggtgcagtgatggccaaagagtgatgagagaatatgaaaaaaaaaacaaaaacggagaacagtaattttgagggcttttgctctacaggacacagataataataagaggaaacacctatatagcatttactgcgtgccagccatccttcttagggctttatgtatgttaatcccatttaatccttacaacagccttgtgaggcaggagtattattatctccactttacagatgaggaaaatgagacacggaaaagttaagtaatgtgaccatataatccctatttctgtattaagagccaatttatagcttctttccaaaacctcatttttaacctgcatgtatttgaagacttttcgacagatccattaaaataatgaaacaatttacaaatgtaatctcttggaacagagaaaggaactcttttctcagattggagctatacatatgactttatccatgtcactctactgtactcaaatcacatagtggttttccataattctgatgtgtgctttcacttattgtgacacagcattattttatttttagtcaaccatctttctatatcaagcatctttatgaaagcataaataggtcactaattgttttcattttcactgaataatttgtttgcattctcatactccattaggcctatataaagcatacaaacatttttttcatcattaatgaatgtataagcctttatgcctaactacattaaaaatagacatgaaaattttaaacaagtgatatattggaaaagaacatactgctacaggataaaagaaaataatttcaacatatgttacagaaaattttttaatattcatgttttataaagagttccccaaaggaataatttttttacaacttgtaagtagaaacatatggcatacagatgtaataaacatttcacaggagaaatataggtgatcaatattatgcacttgtcactaataatgaaaacaaggagataccaattttatcagattagcaaaagttcaaaggattaaaaataactattttttgcctgagtatgggaaagtggacactctaatacattgttgaaatataaatttgtagaaatcttttggggggcaaatatgaatataatctttgctcacttccattactgaaactccattctttaaaatatttatagatgtgttagaaaaagttgtataaagatagaggaaaatatacaccaaattgttaatagcggttatctctgagaatgagggaaggaggcagggaaggtgatgaggggagtctttgacttcttatttgatatttgaaattgttgtatattgttttgaaattgttttataattgaaagtaattaagaaaattaacggctgtctccaccgtgtaaaattaatgttgttcttatgtacatcataacattgagtgggtttgcgttatcgtactgttaacatgtgatagtagagaggtcagaacatttaagtaccctaggtaattagtttgtgtatagtgtagtagtctccaaagaaaggaggggatgttgggaggccgaggtgggtggatcacctgaggtcaggagtttgagaccagcctggccaaaatggccaaaccccgtctctactaaaagtacaaaaataagctgggcatggtggtgggtgcctgtaatcccagctactcaggaggctgaggcaggagaactgcttgaacctgggagcggaggttgcagtgagtcgagatcgcgccactggacaagagcgagactccatctcaaaaaaaaagaaaaaggccgggtgcagtggctcacgcctgtaatcccagcactttgggaggccaaggcaggcggatcacgaggtcaggagatcgagaccatcctggctaacacggtgaaaccccgtctctactaaaaatacaaaaaattagctgggcgcggtggcgggctcagtcccagctactctggaggctgaggaaggagaacggcgtgaacccaggaggcggagcttgcagtgagccgagatggcgccactgcactccagcctgggcaatagagccagactctgtctcaaaaaaaaaaaaaaagaggggatagcggtctatacaccacaagagaaagtgaaatgaacaattagggtatgtgcagaaaatgttagaacatctgttcatattcagtttaaatatcatttttttcctgctctttttaaacatactgttgtaaaataaaacacagacaggtatgtatatcttactgaattactgtaaggcaaacatccttgtaactaccacctagttcaagtggtagaatgttgccagttactccagaaaccttttcccaataacagctccttcctacatagtatttttttttaaataatttttattacccaaatgtgccttggtagaaactgtagcttggtcttgctgttgtttagttattttatttgactcacagtaactgagatctctctttttaatctacaggttgttgcttcttctcttgtgcttagaatttacctgtaaagcactggattattttacctgtagtttcttacagtctggattttacttgatcacatattcataatgtaattcaacataatttgctgtcctctctatttcctgcagattggcagcttaatctagcagcatgttcagattcaagattgatgtctgttatgttcttttttcaggtggtgcataatgcctgggttttgctcttattctgtgctagcagccatttatgctggatgcctagatccattaatttattggaagcagcaaaatggagatatcctaatatatttttgtttttatttatttgctggaatgattttataaagggtcgttttctttcttttactattcagttacccagtggtatagttcatatagaaaacacatggaaaagaatgtttgattcttttccttttatttacctggttttcaaggtaatgaatatgaagtggtggattagatattactgataagatttaatacagtataattattctccttattaaagctcaaattagcccatctttggtcaccagtggggagtgttcttcttttggctcgtaagttttgtttttgaaacagggtctcactctgtcacccaggctgaagtatagtggtgcagtctcggctcactgcaaccttcgcctcctgggttcaagtgattctcccacctcagcctcttaagtagctggactaaaggtgcacaccaccacacccagctaatttttgttttttgtttgtttgtttttgatagagacggggtttcaccatgttggccaggctgatctcaacctcctgacttcaagtgatccacctgcctcagcttcccaaagtgctgggattacaggcatgagccaccacacccagcctcctaagtccttttgacatgatcttggtctagctttgatagcttttatgctatctagtatttttaagatgttttgccacagacatgaaattagccatttctccaagaagcccttttaatggaaaatgatatttcaaaaatctcagtgtgggtgctaaggatgcttattcctactgggttggtcattgtttctaggctttttaagtgaacagagttgggcatttgctagtttctatatctatattgagatacacagaatattttggttcttagggctcaaagaattctacaattcacatatcctataattatttacttgcttcatgctatcctgtaattaaagatagtacttataattaccatatcagttattactagaacaatgaaaatttttaactttatctcccattttctttcttttttcatagttgctctgaatttacattttcaagccatatagccactgcatgttataaattctcccctttaattatcatttaatcatagttccaaagataactacatagttaaagctcatcacaaatctttataatctgattgtgtattaaacattttctagtaatatgactggctaagtgtaagcataaaattaccatcagaaatcaaataacgtatttgataagtaggctctttggaggagtgtgaaatgatgtaattgtttgttgatgttccaagtacgatccacagactgttgccagtctgtaaactgtagttggtccgtgaagagacacatgcagaaattaagtgtaagatttagctacttttatagcagtctgacataaagcatgttagtgtgttttgcaaaagcatcagtagctgacagattggaaacttaaacaacaaaacataactggtccttttccacatgtagtttgaaagacacggttacacacaatctcagcccttatctctacaataattaggtctttcagataagtggtttaagaaacagataaatatgagagaaacatgtagatgtgggctaataaaatttttactgagaagatggatgtaagctagactttggtttggtttggcttgatttggcagggagatatgatcagagatatgagaacatttttaacacggaattgtgggcacacaaaacatatcataaaaatggcctggctagagtagaagatttttaccagttagggaggagagattaaatgggaatagttgtataaaggccttggatcccaagctaaacagctaagacattttcatacagacaataatagggagccattcatgctgcaaaagagtacaaggtacttttttcaatgcctacgaggtacttttttctatgcctaagaatccaataaatagctctactctctgttacttgggttctagtgaataatttatttattagatttatagtacagtattaataagtgatatgaagaaaagcaaaataaggtattttaaattaaggtggtcaaagtgtatttttctagacattggaattaataacatttgtgtccctgaaggctataatacttgttctctcgttttatcttacccaactctaggaatgccttgggaactgccccttcagtctagatatctataatttaaaacttgagttcctacatatttctgaatatgttattttttaaacttgtttttctactaacattgtatcttgattggcttctctgtttattgggtttggtatatctctctaatggtattagctttccacaaatacttgatgatttttggttatgtactgtcttttgtatttgtgatttctggttcacttggttgcgaatgctgtttctctttactgtagcctgccttatgtgatggttaaggtgggaaggaatacaaagccagctacaatgtgcctatagtttgcctctttcagtttggggttctccattcattccttctgaagattacccttaattctaaatttttggacctactgtccacaattgctgttttagacaggcttcacactttcatttcctatagttgaatccagttggagtgggattatgggactgttcggagttaattaccacagctgctccctacctgattatcctgacagtaatttgcaggcctctcttaattattttatctatggtaactgaactcgtacctgaaaatttcttttctgttttttacctccacatagagcagtctctttcctacgtagtttgggctgtggttttatgaattttttttcctctcagtaaatctagtcttaccactttatatctttaaggattcctcaaaatgtctggtccattgataacatatgttcatatgttatagattgtttttaagtattacagattcttttgctttatgtatatcttccctaatgtatatcttctctaatgttttatgaggttgggagcagataggctaataggagtatatatttacccttgcatcatttaggctcagtcttaacatcttgatccaaacttctaattgatgtcctttaaaacatgctttttaatactctgataatagtgtactaaaataatgttgattattgctagtcaaaggcagccatgcaaattaatatacactgttgcatttgaccatttatgtattaccttacctaacagattaataagattttatttcattagaagttattgatattataaagtatttgttctaggaagacaatgataaaatctagtttatattttattaataagttctatcttctgattaaatgaatggtaggtggtaaaagcgtgcctcctgtattaggttacttgtagaatcttttaaataaagaagcaaaatggtttcaaggtaaattagcatctaagaaatgtatttttattctacccattctctcattagtgtaggttagctattcaaattgggtcatttagtttgaaaactctcactcattcttcaaggcacaattcaaatgttattctccggggtcttctaaactctctaagaattgttctctattatatactctcatgatgtttctaatgtattatattagttataggacgtctcattatgttgtaaatattgctttattgggttccttttcaccaaactctgaattcctccatgttttattcatgtttgtgatgttagcatcacagttacttagtaaatggattgtaatacttttaggaatggtaaaatgaatactaaggaaaaggtctctgatttctgaattcttggttcctattccaaagagtcagttctagtcataaattgtgggaaatcctgagatccattttactttagattaaagaattttaataagacatttcagtttggtttaaaatttgttctttatttttatttggtaataagtaccatttgggtttctaattagtattcggttctttgcaacctttgaaaatgcaatgtttagttttaaaaatagaatcctatttttaaaatatatctctaacaaagcccataaatttagatttatcatgtttttattcattttttttgaaggatcagagtaacaatgaaattatgattggagtgatgtcaggaggaattctgatttataagaacagggtacgaatgaatacctttccatggtaagaacatctattgatacttttatgtttaccactgtattactaaatataataatttatattaaaggcagtggctgttgaactattttaatgttgtcattttacttgtgagataaactttatactttatcccacttagttagcacctaccagaagacaccaaaatggtttatttcaaaattactttttaaaaattattacttatgagtttttcttttatggaatttttgaaagatgatcagagctttccagtctttttagcagagatttgcccccagggcaaattgttttaccagcatctaaccaatatgggttttatcagagtttaaccaaagtaggagaatggaaatacccaatttagacccctcctgctttcttgtctcacctaaggaggggttgacctgagaagcaccgaagatcgcagccaagaggcacagaccactaaaccactaagacctaattacaggatgaaagaatgattcctccctgtcccacaccttactgccacatcaacatggctcataaataataacagggaatcacaactaaaataactgtaaggctcagattgtttaggagtcccttagggaaacctgaagacagcaaggatgtgaaaaacaaagatagagaaaattacaacctctgacacctacggtttgtacacaaacattaaacatagtcttatgccttgccaggtctacataaaacttcacaccaaaggcatatttatttctttcttttacccagtatatcatatccagcatttagcaaaaaattacaagacgtgtcgaaaggcagtaaacacaatttgaagaaacaaagcaaggatgagaaccagacccagatatagaagaaattttggaagtattataccagaaatttaaaataactgtaattaatatactaagggaaaagtatatggaaaaagtgtgtaacgtacaagaacagacggaaatgtaagcacagagatggaaaccttatgagaaagaattaaacaggagtgctagaaataaaatgcattgcaacagaaatgaagaatgcctttggtcttatcggtagattatacacaagaaaaaaatgagtgagcttgaagatatgtcaatagaaacttcaaaaaccgaaaagtgatgggaaaaaggaatgaaagaacagtatttaagatatgtgatgggaataaagagagagaagatcagaagaaataaatatctgaaaaaatagtggctgatagttttccaaaattcatgacagccaccgaatcacagatgcagaaagttcagagaatacctagcaggttaaataacccaaaaatccacacttacacactatcatagtcatgctgcagataatcagaaaatcttttaaaaagcaaagcataaaaagcacatttaacctagaggaacaaggtaaaaaatatgttgtatttctcttcagaaaccatgtaagcaagaagaaactggagtgaaatattttggttaaagtgttgaaagaaaaaacccaccaacctggaagtctgtagcaaagttatccttcagaagtgaacgagaaataaagactttcacacacacaaacaaaaattgattgaatttgttaccagtagacctgccttgtgagaaatgttaaaagaagttcttcatagaaaaggaaaataatataagacaggaatctggatctacagaaagaaaagaaagcagagaggggacttcaagatggctgactagagtcacggaggcacttgtgtcttccacaaagaaggaccagatcagcaagtagataaacacacaatgaataggacatttaaaagagaacagaagaattcaacaaggaagtgacagggaacctctgagacacagaaggagagggaagcaaagtagccagcctagccaggatcacctgagagccaggaggaattgcccattgcaaggaaaaggtaagcaagagatcctcaatagttcacatttgcaccaaagattactgcagtccttcttatatgagagaggcccttgaccctcatgggccgtgagactagcatagggagctgcctgaagtccacaccatggcattgtttcagagagggagtttgcactccctctacacaccccctaagacccaggcagttgcaacacaatgccattttgagagctcagaccccatcagaatacatcctgcagtgaggcccagtagctcctgcatttccccactgacaaccctccatgtccacacagagggctgcaaagttgcaagacttaactgcacccaggatacagctaggtcctcgagactgtatctcgtgcagtgtccttcaccctggggaatgggcagtgcagtgtgccagggaggctgtacctgtcataaagggagatgaagcatgtgctcaccacagcctcagagttgcctgcacagggacattaccattgacagcaactcacatcctccggcagcaagaccactgtacagctgcatgtgcctttggggggctaagtaaggactggcctatctgagcacaccttccagggacatttatatgccctgtccaccgtcaccagtgataacatcaagggcctgaacagaggaccatcccagctgctggcacctgtatatgttattcatgaacctagagattgacccacttagaactgtgagggccctcacgtgacatccaagggcctgacgatagatgtgcctcgccctcagctaccacctccagacactgttggagtctaggcattggctggccatacctgcagctgctgacacacacacacacacacacacacacacctttcaggggctcaataatggacctaccttgcctgccactggcacctgtgggcacttcccaggggcccagggactggctcgtccaccctgcctctaccactattgtcccccacatgcatagctcaggaccccaagggatagcccactgatactgctgacaccatgcataccacctggagacccaaggactggcatgcccagcctgccatcaccacagctggtgcccatgaaccagcctacctggcatttccatccccaatacagcttcaccacaacctctacaccctaagccactgaggaactcacagacacctctgacactgattagagccaaataaataatgtgaagactatgctactgcacccatccagaatcaaagccaaagcaccctatccagccaacactataggtacatcacaagaaaaagtttgttcctatgacagccaattcataaaattggaagaagcacctgttacaccagatgtgcagatatcaacgtataaggacagaagaaataaatgcctgaaaaataaaataatgatattaaagaaatgcaatgatatatgacagcttgacaatacagagatatcaagaaaaccattcataatctgaatgagaaattcaactgagagatatttaaaaaaaaaagccaacaaattttggaactgagttcagtgaatgaaataaaaaatacaatagaaagcatcaacaatagactagattaagcagtaacaataatttctgaacccgaagacaggtctttggaaataacctagtaattttttaaaaggctaaaaaagcctgaatgacaaatggaacactgtaaagcagccaaatatttgaattttgaaaatttcagaagagttgggcaaaggcataaaaaaaaaacctatttaagaaaatactagctgaaagcttcccaactcttgcaagacgtagagacgttaagataccagaagctcaaagaaccccacagacattcaacccgaaaaggtctcctccaaggcacttcatagtcaaatttttaaaaatcagagacagaagtctaaaaagagcaagaggaaaggatcaagtcacacataagggaatctccatcagaccaatggcagattcctaatcaaaaaccttacaggccaggagcgaatatggtggtatattcaaactgcagataaaccagtagaaatgctgactgaggatacatcacccaagcaaatctacccttcagaagtgaagtagaaataaagtctttctgagataggcaaaaactgagagaattcatcaccactagatggatctcacaagaaatgcttaagggagtccctacatctggaagtgaaaggatgctatgaactatcatgaaaacacacaaaagtataaaattccctgacagagcagataagatatatctagagtagatgagaaaaagaaaggagtcaaaggttattactacaaaaaaaaaaaaaacaaataatcaagggaaacaataagaggatgaaaggaataaaggatgtacaaaacaatcagaaaacaattagcaaaataacaagaatagatctttacttaacaacattgaatgtatatggtttaagttcccgttaaaacttagacactggctgaatggatgtaaaaaaagaagaccgaattctatgctacctacaagaaactcaacttcacctgtaaaaagcacaatagactaaatgtaaagggaaggaaaaatcccatgtaaatggaaaccaagagcgtacagaagcagttattttagacaaaatatactttgtaaaaaaccataaaaagagacaaggtcaatatcaaatgataaagggatcaattcagcgaaaggatataacaattgtaaatatgtacctaatactggagcacccagatatatgaagtaaatattgttaaagatagagaaacagactccaatacaatagtagttggggacttcagcacaccagattcaccactggacagatcatctagacagaaaacaaacattggacttaatctgcacggtagaccaaaggaacctaataaacatttaaacaacattttatccaacagctgcagaatatgcattcttcacctcagcacgtgaaacactcttcagaaaagaccatatgttaggccacaaaacaagtctcaaaaaaatttttaaatagtaattatatccagtattttctcacaccacaatggaataaaactagaaatcaataacaaggaactttggaaactgtacaaatacatggaaattaaacaacactctcctgaaagactgttgggtcaatgaagaaattaaggcagaaataaaaaaaattattgaaacaaaaacagcaacataacatactagaacctgtgagatacagcaatagcattgctaagagagctatttatagcaataaatgcttacatcagaaaagtagaaagagctcaaataaacagtttaatgatgcatctcaaggaactagaaaagccagaacaaaccaagccccaaatttagtcgaagaaaaagcaataaagatcagagcagaactaaatcaagtagagactgtaaaaataatacaaaggatcaacaaattgaaatttgtattttttgaagtgataaaaatcaactaacaacaaaaaaagaaaaaattatctaggtgtggtggcacatgcctgtagtcctgggtactcgggagactgaggcaggaggatcacttgtgctcaggagttcatcctgagtgacagtgtgagacctgtctgaaaaaaaagaaaagacagaaaaaaactaccagccagtattcctaatgaatatagatgcaaaattcctcaacagaatactagcaaagcaaattcaataatacgtgaaaaagaaacatttttcacgtatctacacgtgatcaagtggagtttatttccaggatgcaaggatagtttaacatacaaatatcagtaagtgaaatactttattacatcaacagattgaaaaccaaaaaccatgcagtcatctcagtagacacataaaaagcatttgataaaattcaacatcccttcatgataaaaactctcaacaaattaggtgtagaagaaacatatcttgacacaatcaaggccataagtgacagttccacagctaacatcatacagaacaggtcaaagctgaaagcttttcttctaagaactaaaagaagacaaggatgcccacgctgaccactcttattcaacataggactggaagtcctagccagagcagtcaggaaagagaatgaaataaaggccatccatataggaaaacaggaagtcaaattgttcctctttgcagaaaacctgatcataaagaaaagcctgaagactccactgaaagtctcttagaactattaagtgaattccgttaagttgcagggaacaaaattaatgtacaaacatctgttacgtttctgtacaccaataatagctggaaaagaaatcaagaacgcaatctcatttacagtacctaccaaatgttacacttaggaataaaccaaggaggtgaaagatctctacaacaaaaactacaaaacactgatgggaaaaaattgaagagaacagaaaaaaagtagaaaaacatctcatactcatgaattagaaaaattagtactgtgaaaatgaccacactacccaaagcattctacagattcaatgcaacatctgtcaaaatatcaatgacattcttcacaggcatagaaaaagcagtttcaaaattcatatgggtggggagccaagtggctcacacctgtaatcctagcgtttttggaggccaaggcaagaggattgcttgaggccaggcatttaataccagcctacacaacatagcaagacctcgtctctataaaaaatatttttaaaaattagctgggcataatggcatgtatttgtagtcctagctactccggaagctgaggtgggaggatcacttgagcccagcactttaagggttacagtgggctatgatcataccactgcacttcagcctggatggcagagtgagaccctttctctattaagaaaaaaaaaaatattgtatggaaccctaaaagatcctgaatagccaaaacaatactgagtcaagaggacaaagatggaagacatcaaattatcctgtgaagctacagtattcacaacagcatggtactggtattaaaatagacacatagacccaacagaacagaatagagaacatagaaataaatccacgtatttacagccaactgaattttgacaaaggcacctagaacatagagtagggaacagacacccttttccataaatggtactgagaaaactgggtatctattgcagaagaatggaaccagacccttatctcagtatataaaaaatcagctccaaatggattagagagttacacgtaagacctgaaactataaaactgctaaatgaacatagaggaaatgcttcagaatactgatctaggcaaagattttatgggtaggtctttaaaagtacaggcaacagaaagaaaaatagtcaaatgggactatcaaactaaaacgcttttacatagcaaaggaaacaatcgacagagtatagagacaacctatagaactggagaaaatatttgcaaattgtacatccaacaagggcctggtatccagaataacaaggaactgaacagcaaaagccagcccaataattcattttttaaaattgacatttctcagaaaaaagacatgcaaatggtcaaattgaaggtttgtggcaaccctgcatcaaacaactctgttgttgccatttttctgccagcatgtgctcacattgtgtctttgtgtcatattttggtagttctcacaataattcaaagttttttattgtgtatgttattgtatcagtgatctttgctcttagtattataattgttttggcatgccacaaaccacacccatataagacagctaacttaagtgatagatattgtattgtttgttctttctgccccactgactggccgtttctgtctctcttcctctccttggaactccctgttcactgagacacaacaatatagaaattagaccaattaataacccttcagtggtctataagtgatcaagtgcaaggaagagttgcacttctgtcactttcgatcaaaaattagaaatgattaagttcagtgaggaaggcatgtcaaagtcaagatagaccaacagctaggcctcttgcaccaattagccaaattgtgaatgcaaaggataaatttttgaaggaattgaaagtactactccattgaacacccaaatgatacaaaagtgaaacagccttattgttgatatggagagtatcttagtggtgtggatacatgaaaccagccacagcattcccttaagcttaatccagaacaaggccctaactctctttaattatgtgaagactgagaagagaggtgagaaagctgcagaagaaaagtttgaagctagtgcaggttggttcatgaggcttaagaaaagaggtcatctccatacataaaagttcaaagtgaagctgcaggttatacagaatatctagctgtctggctaagtgatgaatggctacactaaacaacaggttttcaatgtagatgaaacagccttctattggaagaagatgccatctaagactatcatagatgaagttaatacctggcttcaatgtttcaaaggactgactgactctcttgttgcggaataaagttgaagccagtgctcatttaccattctgtaaatgctaggtcctaaatctaccttacctgtgttctagaaatggaacgtcaaagcctggatgaccacacatctgtttacagcatagcttactgaatattttaagtccattgttaagtcctactgcttagaaaaagattcctttctgaatattactgcccattgacaatgaatgcaccttgccacccatgagctctgttagagatggcaaggaagttgatgcttgctgtcacaatatgaattctgtagctgatagatcaaggagtaattttgactttcaaatcttttttaagaaacatattttgtaaggctgtagtggccattgaggatgatttctctgatggatctgggaaaagtaagttgaaaaccttttggaaaggatttaccattctagatgccattgagaacattcatgattcatggtagaaggtcaaagtagcaacgttaaccggaattttgaagaaattgattccaaccctcatagatgactttgagggggttaagacttcaggggaggaagtaactacaggtggggtggaaataacaagagaactattattaaaagtggagtctgaagatggggtaggggatgaattgctgcaatctcatgataaaacttgaatagatgaggatttgcttcttatggatgagcaaagaaagtgattttttgagatggaatctactattggtgaagatgctgtgagcattgtttaaatgacaacaaagaatatagactatttcatgataaagcagcagctgggtgaagaggattgactgttttgaaagaagttctagtgtaggtaagtgctatcaaatagcatttggcaatgtggtcttgccacattgtggcaagaccctccaccaacaaaagattacaactcctgagggctcagatgatcattagaattttttataaattactctgattttttattatacaacttgttttcattatagtatatcgaactcttaatagactacagtatagtgtaaccataacttttatatccactgagaaaccaaaaaatagtgtgactcactttatcacagtattcgctttagtagtctggaactaagccctcagtatctctaaagtttggctgtaccaatatccagaatgaaaggggatagcattacagaccctacatacattaaaagcataataaaatcatattgtgagcagatttgaatgtttgaatattgatatggtttggctctgtgtcctgccccctcctccactaatctcaccttgacttgtagtctccataatccccatgtgtcaagggtgggaccaggtggaggtagttgaatgatagggacagtttcccccattgtgttctcatgataatgagtgagtctcatgatatctgttggttttataatcatctggcatttcccctgcttgcacttctccttcctgctgccttgtgaataaagtaccttgcttgccctttgccttctgctgtgactgtaaatttcctgaggtctccccagccaggctgaactgtgagtcaattaaacctctttccccaataaattacccagtctcgggcatgtctttattagcagtgtgagaatggactaatacaagtaccattaataaatttcacaacgtagattaaatgtgcaaattccttgaaagacacaaattaaaaaatgacctgagaagaaaagaaacttgaatagatctgtatctattaaagaagttgaaattataattagaaaccttttgaacattagaactccaggccccttgttgtgaattctatcgaacatttaaagtagaagtgaggccaattttacataagctcttttagacaataaagaaggaacatggtttatgtgattattaccttgatgttaaaaccagacttaagaccttacaaggaaagaaaactgcagttactcatgaacatagatgcaaaaatacctaataaaagtttagcaaattctatccagtaatatataaaaatgacaattcatcatgttcaaatgggggttattttaagaatataaggttgctttaacatctgaaagtcagtcagtataattaaccatactgttataataacatagaaaaaccatttgagcatttcaatagatgcagaaaaagaatttgacaaaattgaccattcatgatttaaaaaaataaagacatagctaactataaatacaaggcactttctattttgattaagggcatctacaaaaaatctgctaatattatacaaaatggtgaaagtctcaatgctttttatataagatgaggaaaatatatgcttcatctcactacttctcttcagctttgtacaccaggtccttactagtgttttaaaaaaagaaaaaggaaaaaggaataaaaggcaaacaaatggggaagaaaaaagtataatggctttccttgtagataagaatatatatatagattggctgaaaataaagagataaaaaaggtataccatgcaagtagtaagcattaaggagactagaatgactgtattattataatatatacaatggtccaaccagtctagaaaactgttctgtagtttcttaaaaagttagaaatatgtctaccatatgacctagctgtttcactcctacctggtatttgaccaccagaaattaaagcaaatgtttgtacaaagacttgcacacatgtgttcaaagtgactttatttgtaatagccgaaaactagaaacaacttaaatattcatcatgaagtgatggctatttccatccatgttgtggtatatccatagaatggaatgctcctcagcaaagtggagaaaagatttagtgaaaaacacaatgcagatgaatctctaaataattaagcggagtgacaagacagatgaagaaaaatacatactgtatgcttccatttatataaattctagaaaattctatctgtagggacaaaaagttggtcagtggttacgtaggcgggatgggttgctgtgttggagttctagaggaggatcactgtgtggcggaaggaatcttttggaagtgatagatatgttcactatcttgactgtgatgatggtttgataagtacacatgtatgtcacacttaccaaagtatatactttaaatatgtgcattttgcatgtcagttatacataataaaatgcttaaaagggaaaatgaaaagatgcattggtggtataatgatgagcctagctgctttccaaaaccatgtgaaagttaatcagtaaaacagtataaaatagttatatgattacataattggcattccagtagaaacagaaaactttggacaagtagcaaaaaaaattatggtagagataaatccaagtatgttaattattatcgaaactgtaaatatgttggatattcatattgaaaacatcaaactgaatttttaaatcactattgatataatctatgtaccataaatttgcctattaaagtatacagtttagtggtttgtggtatagtttcaggggcagcatcaccataatctaattttgaatcatttatattacccctaaaagataaccttgtaattattaggagccatttcctgttcttttctatgctttttatttgccagaagtcttaggcaatcactaatcactatcatatatctctatagatatgcctattctatatattctattaatattgaatgagatcatgtactgtgtggtcttttgtgattgatttttttcattcatttttgaggttcatccgcattgtagtatgtatcagttttgctttcccctttattgctgaataattttccattttatggttataccacattttgataaccagttcaccagttttttcccctttttggctggtgagaattatgttgctctgaacatttgtacaagtttttgtgtggacatgttttcatttttcatgagtgtatatatctaggagtggaatacctgggtttgctaaactgttttcaaacgtggctgcatcattttacgttcccaccagcattgcatgtgggtttaatttctccagattctcaccagcacttgttatctgcatttttattataaccattctagtgagtataaagtagtatctcattgtagtttttatttgcattcccctgctggctaatgataatgagtgtcttttcaagtacttattattgtttcatatattttggattattcaaactggatttttaaaaatcaatctgagccagatgcagtggcacacacctatagtcccagctactcaggaggctgaggcaggaggatcacttgagcctaggagtttgaggccaggctgggcaacatagcgaaaccatgtctgtaataggatacattttaagatggcaaaggcaaaccttaaactgaaatgtaaagtcattgtaaaacctctgatgtcaagtgaaaaatgcgtagtatgtctaatgatttattaactacagaaaggaattgttccagttaaaaaaaaatcaatctttatactgtttacaagagacatacctaaaatgttatacaaaatgacagaaacattgaaaaagataaaccaggcatatagaagccaaaaaaacggttatggctatattactgctatataaaatagatactgtttgaaagatttttaatttatacattggtatttttctgaaaaaactttgtagcaaatacaagtcacacacaatacatttataagaaaataaaagttatacaaaatatatattatgccacagagagcattcagtgaaaagatttttattcattgattgataccttcctgggaatttttgaaattaaagtgatttgaaactggcctagatttcctttctcttgatcatttagaaatgaacagtgttttttgttgtttaacttctgaaatatcagtgtgtcttcataagattttttgaattgaggcacctggcttttttccataaatacagtcaatagttactcaattttttttttttttttttttttttttttgcttctggaaataatgccctctctctatgacagaatatttttcccatgtcgagtgaaagctcagtatccaaaagtaaaatacaaagttttcaaatcagaaacctaaacatgtctcttcttccctattccaaacatgcatgcttgaaaagttgactcatgcatttgcctcttcaagtgattaaagtgtgagaagtttattctttgagaatgctgagagcttcttggatagatagggccataagccataaagattaagacttagaattatcatgaaaatatttacttagaagactgagacaggatcctgaaggacatttttctcagtaagaaagatcaaatctctttagccttattacccttatgtcttaaagtttacaaagactgtgtttactgtgttacttattttatggtttcaatgagacaaaatgacttggctcatattgattgtactaataaggctttgagaacgcttatggcattatgtgggttgcgtttaagaagaagggtggtgtacaaaggtaaatttttaaaatttaatgctttttaaaattaaaagtgtttttagggttgttgcataaagtaatgaaatcttacatttttccaaggcttgcttatagttttagagagtaaacaactaagttagtgatagtttttgaaattttaatttgtgacatctgtttttaagtatttctgtagatacaaaattttcctcagttgaacacaaatactaattattttttccatgaagcaagaaaaactttcaattctttatgtactatgtgtatgtatatatgataaaatgtttagatattactaaatatacacttaaaacattttttcataatttgttaatatttttatcattattcaatactttgaataatttattgtcttttgtccaggttgaagattgtaaaaatttcttttaagtgcaaacagttttttattcaacttagaaaagaattggtgagtacggatttaataattattgacataaatgaagccttttaagaaatacccattcatgacagaacttttctattattagtacaagtgaaagtgcaattaatactgtggataactgcccgctgaggtaatgaattcacttgttataacaaaatgtacttgtttttccagtgtgtatgtggttctaatttaaagttcttctagatattcctcttgctgtttctcgagcttagaaactgatttctcacacatgatgttcattgaaaacctcagggtccatttttgaagggcagcaaatgagcatttcatatatccctttttccctactaaatctatagtacttactttcgtatataagttcattttattttaggggagctgagtgttacaagttcatgaacttataacacattgcctccctttgttggagtggtaatggctttatatattataaataacaaattgagttgtcatggaaagtacagtgttggaaataatttcatcttgttaatgattttgtctgtttcattaaatcaaactaaccttatcctttgatgtacattatttcttagaaatctgagaagtcttggcaaattcatgcagatttcaagatggttgtgtgtgtatgtgtgtaaaatgtatttgaaaccataaaaatgtctttggggctgtcctcagtggctcaatcctgtaatcccagcactttgagaggctgaggtgggaggatcccttgaggccaggagttccagaccagccttggccacatagtgagacactgtctctacaaaaaaaaaatggaaaaaaaaaattggccaggtgtgatgatgtgtgcctctagtcccagctactcaggaggctgaggtgggaggctctctggagcccaggaattcaaggctgcaatgagctatcatcacaccattgcactccagcctggatgacatagggaggccctgtctcaaaaaaaaaaaaaaaaaaagcctttgggtacagtggtggcttctacctgttatcccagctacttggaaggctgaggtgggtggataggttgagcccaggagttcaaggctgcaatgagctgattgtgccactgtagtccagcatgggcaacagagcaggacaccactgcctcttgaaaaataaagaaagtctttgaatcagctctgttgtattggtctactacgtgattataaactatggtttatcgtttatgttcataaaatacagagggatttttttcaagagaatttttattgaaataaaacataataccaaaaatgtgcatattttaagtacacaacttgatgaagtgaacatatccatatcagcacctccaagatatgtagtatatgtaccgccttctaatatgtagaactttaccagcaccccagatgcttgaaatgttgctgctggagctgatgcccacttccagtcattaagcctcctggaaggtaaacattactctcatttgtatgaccatggattagtttgcttatatttgaactttaaaaattgaaattatacagttgttgtctttactgtctgccttctttcccttaatattttttgtgagattcatccatgttgttgcatataacattagttcgttccatttatgtatggtattcctctgaatgactatgccataaattattaattcattctgctgctagtggacagctttgccatttccaggttggggatattatgactaatgctgctaatggaaattattttacatgttttaaaatttaggtgattaaaatataatattgttatctggaaactagaggacaaatattttactttaagtaatcatagatggcactgtagaagtcaacttttctaattagacttataataatatcccatcataatactagtgttattaataatagttataatatccagcctttattgagaacttactatgtgcctggtaaaagaccagtcattttcatatcactgaatcctcactctcattttctgaagtagtgtaccagttaaaaatgtatttaccaataagtgataacagcaacaatagctaactgacaattgattaaagacagtatacagggatccttttgtggttcataagcatgatgattagattttcatgctattgggtgagatatgccttcctcagactttgttacagcataggcacattacaacctgtctgataggagaaagaaagtaaagatggtatacaggccaggtgcggtggctcacgcctgtaatcccagcactgtgggaggctgaggtgggtggattgctttaggcctggagttcaagaccagcctggcccacatggcaaaaccccatctctactaaaatacaaaaaaatggttgtggtggcacacacctgtatttcccgttgcttgggaggctaaggcacaagaatctcttgaaccaggaggtggaggttgcagtgagccaatatcgcaccactgtactccagcccggacaacagagctggactctgtctcaaaaaaaacaaaagaaaaaaggaaaaaaaagacagtatacaggcatactctgcaaaaggtggccttgttaatgttttctctctaaaacatctttgtttttaaatacccaaacttcatacgatatacttatctctcagtacaaatttttttgtgtgttgtttagaaattgggcaagaaaaatttttgttacatttcaaatataattgatagaatatggaaattacttatagactttttgaaaagtataccaagtgtcaaaatgggtgaatatgtatgcatcttagatgctgacagtgagaagcttcagtgcatcatagtagctgagacattttctgttattttgtgtaatgtttgtggcatatggtaaaacatatgaactatatatgttagtgcaaacaaaacaactattaaccataattaagacaattttctggcaatcaagaagtgatgttttaagcatattcccttctaatatgatagtttaatactttatacatgggcatttatttgtgtattagtcacaggaaatatcttaatgaccttttgatgggcaagaatttctttaaccggacatagaaggaaaccttcatacccttaaaagattgatgatttggactatgttaaaattaataactctgttcatcaaaagatatcactaagagagtgaaatagtatagaccattatataatacacacagaatccttggttgtatatgcatcctgatagaaatatatgccagtgaattgaacagacacttcacaaatgaggatatccacgtggccattaacattgaacctcaataattataaaggaggttcagattataaccaaaatgtgctacctctacatacacaacagaatagtaaggggaaagagattgataaaccagtggttggtgaatatatggcacatatgctactggtgggagggattgtatattgatctacccattttggaaaactgttgggcattatctaccaaagctgagcatatgtgtacaacatatgacccaacaacaaaaatgtgcatatgtgtacaccagagaacatacaggaatatgcatggctgcattcttcttatatccccaaactagaaatataaaatgtctgtgaacagtaaagtggataagttaactgttaaattcattataatagagtactatggaaattagtgaattactgcttcataaacgttgaatttatatcagaaacataatgctgaacaaaagccagacctaaagacacatatgtttgattccatgtatgtacaataaagttcaaaaacaagcatgactattctatggtgataaaggcagaagagtgattaactttgggaaggtaatctggtagaaaggggagacaaaggatacttctgtggtggtagtaatgatccatttctggaactgggtaaaggttacatggttgtatttattgtgtgaaaatcagagctgtgcaattatgggatgtgaatgttgctatatgtggtttactttaaggaaattatttatttagaaatttgtaccagttttcaagaaaatggaaaattattttagtgctaattttaaattttgaattatgtaatagtgttcagagctgctgaatgttctttatttacaatctagacagatattttaaattaggaatattgttaaaagttgtgatgatatattttaacatttaatttatggcctagaattatattttgaaacagagtcatagctaatgttgaaaacagatacatattaaaagtttgaactcatttctaactatgatctaaggttaaagttcctaagagttataatatgaatgaacaaggccagcacgggggctcatgatataatcccagcactttgtgaggccaaggcaggtagatcacttgaggtcaggagttcaagaccagcctggccaccatggtgaaaccccgtctctactaaacatagaaaaagttagctgggtgtggtggtgcatgcctttaattcctgctgctcgggaggctgaggcacaagaatcacttgaacccatgaggtggaggttgcagtgagccaagatcgtgccactgcactccagcatggatgacagagtgagactgtgtctcaaaaaaaaaaaaaaaaaaaaagactgagttaggtccagatttttcaggcttttgcatatacttcattgcctttttattggataagcaaaaaagatcctagataaaagatcccataggttctatctatatcattaacaagttcatgtttacaaggctagaataatttatctgtcaaaagtaaattaaatggagcattagatcctgacattttcctggtattctctgcattttgtcatttattacagcatgaatctagagaaacattattgggatttaatatggtgaattacagagcatgtaaaaatttgtggaaagcatgtgtagaacatcacacattcttccgtttggacagaccacttccacctcaaaagaatttttttgcacattattttacattaggttcaaaattccggtactggtaagtattgcttctgtgttaaggctttattgttggattttgtttcctttctttaaaataaagatgtagtttatggaaccatacaacctttgttacacaaacttaactgagtcaaaaatccctatggattgcagcctctatatcagtatcattaaaaagttctataggttcttgtgatatgctacaggcttgagaaaccagttctgtgttctgtatttgctgtcattattttctggagtaaattaactacatttacttatttacaataaagacagatgacataatttctattgtgtctttattagatatttgcttgaaaacttttctttgttctaagacacccaaggtatcttatgcctaaaactatataattattgttttttaatttagaatttagcatatttttgggttgtcaaaccctttattgtaaagtgtttaaaacagtcacgaggcaaaatcagatttagtcattgaacagtaaccccaggttccatttcctaaaattgttttattcttgatagcttttattttttcctgacggcaacaaatctttggggaataactaaatctgaagaagctctgattagttttacctttggaattcttaaaagacccatgcaagctagtttttaagtggaacctggtaagaatcatgtagaaagttattcattatcttttagtaaaacaaatgttattcattcttgtttgtttatgcttcacataataagatttttcatctttgataaataaaacccttggccagtcgcaatggctcacacctgtaatcccagctctttgggaggccgaggcaggcggatcaccagaggtcaggagttcaagaccagcctggccaacatggtgaaaccccgtctctaccaaaaacaaaaaacaaaaaattagctggctgtggtggtgggcgcttgtaatcccagctacttgggaggctgaggcacgagaattgcttgaacccaggaggcaggggtttcatgagccgacatctcgccattgcactccagcctgggtgacagagcaagactccatctcaaaaataaaaataaaataaaatgaaaaacccttgaccattatgtgttaagattaattcatgttatatgttcatgagaaaaatgtttagatgttcccagaaaagatttaaattgtaaacctaaacatgtataattgcctaatttgtaatctccgtaaaaataacagtatgaagcttagtacaggatatgtcacttgaaatacatgactcccaccccagaaaaattagtaaaagtggctcaaaagttcagtagtaacaattaaacagaattagaatatttttaaccaaacaaaaggcacagtaatttcctaagcagtttgctgtcacgtttaactcctttttttttttttgccttcctaaaagcaattttgagtaaagtaagatgacagtacttgcaaatttaaaagcaaatagatggaaggagagagtatcagatctataatgaaagtcaaggaaaaagcaaagagccttacctactgttaataaatctcagcaaggacagaagaaatctccacggctttatgtgaaatgagaacagtacaaaccctaaagatattctttcaatgaatttaatttctgattggttaccagggtagttatacaaggactactcttaccctctgttcaaattcttttttctcctctttgtccttgcaaatgtgacataaacacacaccatttaatttaggtacaaagaaatgagtaggaccaataaccagtcttcaactataattcaagcaagtctcagacaagatgagaaaagaaagtcaaggaagttacccaaaccataccaaagcaaacataaaatttacatacggtgacttcaaatacaaaagacagttgaagaaacctgtttgggaggaaatcatcactgaaacagaaggaaatttgtaccataaatattaataaaagcaagttcaaggacaatctgatttaaaaaaaaaaaaaaaaaaaaaagatcggccgggaagggagcaacacctgccattcagaaggctgttactgcccttggggaagattggcctagtattgacaaattttacatgtttttcgacaaaactgggattaaggactattaaatgggatatgtacattttagaaagttgaacaattattttaacagctttattgaagtataattgacacataagaaatgatcatattcaaactttaaaatctgatgttagtatgatgaattactttgattgcatttcaagtgttaagccagccctacattcctaggataaaccccacttagccatgatatcctttatatatattgtttgattcactttgctaaattttgtttaggatttttgcatatgtgtttatgagggatatatctctgtagttttctttcgtacgatatcattttcagattttattgtgtcagggtcaaattggaatcatgaatgtgttgagaaagttccattttctggaagaggctgcatagtaataatattatctcatttttaaatgtttcatagaatttgcaaattaattcatctggggcagaagtcttacttataggaaggttttgaacattcaaattctttaatagataaggcaattaaggttttgtctttcttcctgagcaagatatggtagtttctgtctgtcagcaaatttatccatttcatctaggttgttgaatttattggcacagagtttataatattccccatttctttttaatctctctagaatatgtaataatgttgcttctctcattcttggtaacttgtgtcttcttttttccttgattagtctgctagtggtttatcagtttgaattaaatattttaaaataatgtaggccaggcatgggggcctgtaatctcagtgttgtgggagaccaaggtgggaggattgtttgaggccaggagttcaagtccagcctgggcaacataggcagacccctgtctctaccaaaagtttaaaaactagctgggcttttggcacacacctgtagtcctaactactcaggaggctcagggaggaggatcacttgaggccaggagttaaaagttacaggactatgatcaggccactgcacttcagcctgggtgacagagcaagaccctgtctctaaacaacaacaaacagtatgtattccaaataaaacttgtatcttcaggcttatgttacttgtgggccatcctttgtcaaccaagtcctaaagacaaaaacatgaccaaaaaatattaaacatgatcacattgccattcaagtccaaagtcaacatatagacattatccaatatgcaaaaactcagagaatataacatctccaggaccttcctgaaaacatttattaagtagtaaaattcagcaaaccaggagataaatcagaataatcctgattaaaaaaataactttttatcaggtataaaaaaataactttttatcaggtataaaaagttatttttatataaaaagccctgagagtgaagattaaatcctctctatatagaaacaattcttgacaaccgtgagaattataactgcagaataaaatttaaatggtataaactttgccaaagtagaataagtaatataactttaaaaaaatgaggctgggcacggtggctcacgcctgtaatcccagcactttgggaggtcgaggcgggcggatcacgaggtcagcagatcgagaccatcttggctaatgcggtgaaaccctgtctctactaaaaatacaaaaaattagccgggcgtagtggtgggcacctgtagtcccagttactcgggaggctgaggcagaagaatggcgtgaacccaggaggcagagcttgcagtgagccgagatggagccactgcactccagcctgggcgacagagtgagactccgtctcaaaaaaaaaaaaaaaaaaaagcaagggactagtgggaggaagtatttgaatccttaaagtttgaaacaattttagacattaacacagcagttcttaaggttttcttcatcttttttccttttttttaatatgaatggcagtcttttttatcttttatttcactggaaaccagtttaatttttttcgttaaaagtggcatatataccatagtttcattgtaataaaattattgtgcctgtatgtctagcctttttaatgtttatatacatgaatttcagaatgatttttacctgctcataatggtgatgatttctttatggataggactgtgggtaaaaacaatttttttgttctttttatatttttctatgttgcttgaataacttataataagcctatatataaagagagagagaaagagagagaactttctcattgctcaaaagataagtatcttactgtgaaagtttagtgttctgaaactggaacagtttttcattttgttgtaatgataatactaaatccctaatgtctgtattatggacaatatgaaatataagcctttctttcattaattttaaaaaaaattgtttctttattatgaaatttaacttgttactccagccttttgagtaatagtatcccatttgaatcttcttcactggaaaattaaggtatcagtcagagttcagtcagggaagcagaaagcccttttggtatttcaaacaaaagcaatttaattgaggaaattagttacatggttgttggaaatgctgggaaaacaaaagggtggaaacatggttatggagaaaaaaacaagaagaaggggtaatgcctaaaattcagatgcattcaggactccctgggctggagtccacaaactacacctgctactacactgttagagctctgtttccctgactgaactctgactgatacattaattttccagtgaagaaaaatcagtctgcatcttgcagagaagtactgctttaatcaaggatgggaccatctacaggatgctctttctcactataccctatccccatgactattaaagcagctgccagcagctgccagtttcctgctctgcctttctccactttctgatcttccaccagtaccttctaaaagcagaacctaaggcaaaataatctagaaaatggaatttgtttatcatagcccctgcaaaacatagggcacaggacaggactgggcctatgacagctcgcacattaaattgtatatacataattgtgtatatttatagttttaaaaagttaagctttgcgtttgtagtccttaagaactttaaaacatatccaaagcactttttaatcatcaaagtggttagacatcttgtaaatgaagtaggaatgggagaactttaaaacttatccaaagcactttttaatcatccaagtggttagacatcttgtaaatgaagtaggaatgaagtaggaaatgaagtaaaaatgttaactggacacagtcctgtccctaatgagtatgcactaaataaactttttttcccttcataataagcagtggtggagaatactggaactgttgtcatacttaaaatgttgaaatactcttttgactgacagatggtactgggactatcagatctattactttctccaccagtctcttcatgtacatatccttatctctgttccaaagtatccagaggattaacatcattattctaatgtggaaatacaaaacagtgatgaactttaatttattacctccctcttagaggaaatattttcttaggaaaattcaacttgaagtttaaaagtcatggtagtatttctcatttttccgttaaaatctcataaaagtgccattcagttcatatttactgatatttatccatggaaaatggtcttaaaattgcttgcttaactatggaaactggcatttggctgtttttatatgcattagatagctatatttgtatatggttacatttgatataccgcaaatttatgttaattcacagttaagtaatgagaatgtctcaaataaatgctctgagaacttttattaacaaacttcatctgaacacattggtgtacttcagaagaagatcagtttctctctatcaacaatttccctctagacaaatcagcttgaaaacaaatctcctagtgccaaaaccccaccatttttctgccttagttccttcctctaaacaaaaatctggagctgttctgtgtctggacatggagggagttgaacacatctttcttcattaatgggagaaatgtaactaagcttcattcatccaggtagaattggaatgttgtccagtctttttattctctgcttccttttctctgctagaaatgtcttgtctcttaggaagttacactataatcatgttatgtgttgtcattttatcttatagttctcttaagactttattgttgtgcatatttatatatttcagtgggagaactgaagtccaatcagttcagtatggcaaagaaaaggcaaataaagacagggtatttgcaaggtaagccaaatctgtttcattgtttgaatttttttaaaaagatggattgagtttactaaaaagtttttctaaatattttttctaaagtttttctaaatatttcaaatttttgattacagaattatcacaattctttaacagtaaataatgttgagggaatgataaactagcttgtctagtttattgattcattttttatattaatagtgtgccaggcattgcagttctgaataggctgatcaaatattatgttattaatataatattctgttcgaggttgctccacttttttaaacatttttgagaaatatagtgacttatttcatgttatcaagccatttccatatttatttaaattataatgttaagagataagttgttttattttttgtttttgtttaccatttattgtctttatttctttagggtctgtcatagccaatttgcttttttttttttttttttgagacggagtcttaccctgtcatccaggctggagtgcagtggtgcaatttcagctcactgcaacctctgccttctgggttcaagtgattctcctgcctcagcctccctagtagctgggattacgcatgccaccacacctggctaatatttttgtatttttagtagagatggggtttaccatgtcagccaggctagtctcgaactcgtgacctcaggtgatcccccccaccttggcctcccaaagtgctggcattacaggcatgagccaccactcccgacctagccaatttgctttttaacaagtgaaatgacatgataagatctatgttttagaaaatagtattatgagcaatgatagagaatggattagcgaggaaagcctcggtacccagaaactataaggtaattgcagtaatccaagtgaaaataataaaggcctgaacaaaaacattggtaatggaatggaaaatagggaacaaatttaaggaacgttttgtaggcagaactagcagaagctgatgaccaactggatacaggtgtgttagagacaagagtttgttttcagtgaaaattactttgagaggctaagtcttttaattagttatgtgtttggcatctactgctattagaggcttgagttttaataaagagaactagaaagtttgcttttgatttcactttgtttaaattttgttcttaagtctttatctaagagaccttccttctttgtgtttctggagtaaagggagttttgtgttcttggtttttttcttcctccttccaaaagtggaaattgcttttttcccctagtaatataagtgatagctcattatgtttaaaaactccaacagtatcaaagagcataaagaaaatttatcatcccaagacaactttttaaaaaaattttgatactcattattcaggatttttctatgcatatactcatagagacatttttatatatgtgtgtatatttgtttccaaattgttttaaactatttgttgtttgtttttatcatctagcatatcgtgcacattttctttgctgttcaaaaatctagtcatttataatggcaataaatcttttaacagttaaattctttgattgtaaactgtaaacttaacttttaggattcctccctttactgagccacgtccctgcctccagagtaggagttgttgctaagactttgtaaggatgtcacagtaatatgtgacatacagcttacatttagtagtctactatatgaggaaataatagtttattacattatgaattaacattaatagaagagccataaatggtaagttaatctttattttaaaaatcaaatgcatgagataatatactttattttcattctgttgtgactgataggaaaatttgcactgcaatatgagggggttggaccaaacggtgtcatgagttgtcttctaatcaaaaaatcctataatttaaacctgtgataatggaaaatcttcacacctaaattactttgaattcacttatggaaaatgaaatgagtccatgtattttttaaaaaacgaataacatttcttaaaatatttttctgattcttagtgttgtaacagcgtagcaatatacttaaaactttcctttcttaacaagtgtcttctttctgcttgacttttataaacagtgtagaacgtgcgatgtggtcactagttgtatgcagcatatcctcatacgagtaccagatcgtaggcatatttatgtattaagttaatatcacatacaaatggtttctttataagtgttaatgttttcatgttttgatcctatcagattttagaaataagcagagttatacctgcatcttagttgttcattttgtgtattcattattaaaatgtatagttgtttaataggttattttataaaacaaatagccatgattccgtgaatagtagaggtaaaatttcaatattataagcctcagataactctcttccttttgtttttctggaattgtgtggttcctctgaaataataaggtatcagctacaatgaggttgtaatagtactgggctgtttaatgatctctctttctctgaaagataagcttttctgggattgtttttctaatatgttaggatctaattgtaatgaacagatatatgtctaccaaaattctctaatggttttagtaattattaagttattttattaaagtaccagataacctagagttctttttttttctttgggttttagttggcaatatgagtagatagaaaaggctcctccttaaacttctcatataataattttttagcaatcattaaatgttttttcttttttctgattatcacctctttgtgttcgcctcagcagcacatatactgattatcacctcttcaaattgctttcacattttgcagttgtcatataatatatctaagaaaagagaaaaacaatgttctcatacaacagaaaaataaggtgccctagacagaaaagaagcttaccacatcgcaaacacactgatgctgtgtggtatttttttctctgaaatttccacactcaacaggaaacatagacagcaagcttgagtgggtgggtccctgaggttaaaactgttaataaaataaaatacatgaagtttggttttaagttcaaagtgtccagccatgtttagtccattaacagcaataaagtgttctgacgcttcagactaggtgagtgtgctggaattttttttcttcaaatgactttttccagcttttagaaaatgaaagtagttgatctattgattacagttagtgaactttcatacagcttacatttcgtagtttaatatttgaggaaataatagtttattacattatgaattagcattaatagagccataaatgttaatctttattttaaaaatcaaagttttatgcatgaggtaatatactttattttcattctgttgtgactgataagaaaatttgcactgcaatatgagggagttgaactaaacggtgtcatgagttgtcttcaaatcaaaaaatcctataatttaaacctgtgataatgggaaatgttcacacctaaattactttgaattcacttacggaaaatgaaatctgagtcaatgtatcttttttaaaactaataacattccatgtcttataaaatgcctacaagatttttgattaaggaaatgtcattaggccaaactaaaaaagttttagctatgaattgctgaaatgacaggacacttctgtggtgtagattcataagtaacttaaatttttcgtggtttagtaaaattaataggctaaaatattgccctgaaaatttggatattcataaatcataaaattcaggaggtagggagagacctatgggtcatattatgctaataaatttatacatttagatacagaaacataagaggtctgtctaataggaagccacatctagaattcagagtccttatcattattttaatgcttcctactgtacacataataacaatttgttcagttctctttggtcagtgttattgtgcgtgttagtccgacatttctttttacacgtttaacatattggaaaggaaattctagcaggcagtgaaacttcaaacttcatgagatcattatgtatcagaattctaatgttattaagttttaatgtaatcagatgagttaatattgcatttgctttgtgccttccttggtaattgtttttttttttttagccatacagaagtgtatacatagtacatgatgagagaaaaatatcccaatgagctaaaaaagcaagtccaatactacctgcaattctttatcaatataagaaaatctgaaaataaatccaaagtcacacaacaaaggcctatgattcttattaactataaccaaaaatagtcttcatttttaaattttactcaaataggtatttctacctaaatttttatgatctgatttttgtaggaagacaacaggatgtttcattttttgtaaattgtgctggaatggaaaatacatatagtttttatatgcttcagttaattactgaaatataaaactgtttacaagatgatttattatatactttatatatgtagcttaaattattcgcctccacattaactctgcacttcataaagccaggcatttaaagaaataacatatattttcagctaattttgtctattatctgaatttgcatataaaaaatactttatttgttaacattcctaaaattctaagggtttatgatctctgcatagatcagtatcttttgatctgaatgaatcaatatgaagatctttctttctttctttcttttttttttttttttttttttttttgagacagggttttactcttgtcacccaggttggaatgcagtggtgctatcacagctcactgcagtctcaaattcctggactcaagttgatcctctgacttcagcctcccaagtagcttggactacaggcacttgccatcatacccagctaatttattttttgtagagacagagtctccttatgttgcccaagctggtcttgaattcctaagttccagtgatcctcccacctgggcctcccaaagtgctgggattgcagcactgagccacctcgcgcatccaagatctttttttaaaacatcacttagttttcatctttatcattaggatagctgataatatatagattggtaacaaaacatatccttttactccccaccaatagacagaattattaaccctccaaaatgtttttggaaaaaagggaaaaatccactaacctactatatgtaaacaattttttaagtagataaaatgtaatatgcataattatttttgttctgtcttcattgaggcagaggattgggatttagttatagaagcattcaggagataatgtgcgaggagttatttaatacatcccaagataagctagtgttccagatactctggaatagaagtaggtagtatctgtcttgtcagtaacatctgagaaaacatttggtagcaaacccttccctttttacctttgtccttccttttcttgtttcttctgtttttctcatccttcttattgtctatcttactcttcctagcctgtcttacctttattcttcatataaagccaatgtacattcttaggaagttatttggtaaatagcctctaaatgcattaattttttacaagtaaactctttatgttgctcatctagaacataatctctgaaaacaaattgtaggatttgattcatggtttggggtataaaaataaaacttttaacatattatttaatttatttctgcagatccccaagtaagcccttggcacggaaattaatggattgggaagtagtaagcagaaattcaatatctgatgacaggttagaaacacaaagtcttccatcacgatctccaccgggaactcctaatcagtaagtgtgaattttgtgaccaacatcaggtgtgaattttgctaatttctaattattggctgtatatttttatgcctgaagacaaagatacgcaaaaattgaattcttttggtgaaacatgatttttgttgctccagagcattattttctctttgcctgctgctctttgcagaagtaacatggtatagacttgcggaatgagagtagcgcattgaataaggaccctccactctcactctcctcaacagttaactttcgcagttaagagtccctgataaatgaagatctgttagacttaaaatcttgtatggttgttgttgacatactcatttttcatgtggattcccagcagaatttctaggggagcatatattgtttgaaaatgctttgcaagtgattgggattctcttaaacccccagctcaaccatggcttcagcacgttctatggcctaggaaaaggggtttccagcaccagtccccataagcttagctctccctgagctaaaaagcactgtgtgattcagcacttaccgtatatgtacttcagtctgacattgctcacaaaagttgtatgttttggtataaatgattataagttcataaactagccaaatgtaccagccaaagatgttgattatcttaatttgataatattacaaatgttgtatgtaattaagataatggtaaacaattgtgtgccaccatattaacatacttagttaacccataaggttcacttataaaatacttgaattttggtatgaaatataatatttgaagatgtcttttttcataaatgttttacacacattaatgtttaataaatttgtataaaattctaaacgtggctgggtgcagtggctcattcctgtaatcccagcactttgggaggccaaagtgtgtggattccttaaggtcaggagctcaagaccagcctggtgaacatagtgaaaccccatctttacaaaaacatacaaaaattagctgagcatggtggcgtgcacctgtcaggggggtggggcagggattgctagaacccaggaggaagaggttgcagagttgagatcacaccactgcacttcagcctggaccacagagtgagaccctgtctcaaaaaaaaaaaaaaaaaaatctaacagctagagcattgaaggctattatcagctgaagaataaagttctaccatatcagaacagtttatacataaacagtttggttcacagagctttaatacttaacgtgttaaagttactcctagaaaaaaatggacttagtaatttctgtcttgccaatttcaggttgcttttatcattttttcttataaatgattacatatattcaaagcctcattagcttgtctgaagaaaattcagaccttgtttttctcttcccttttgcacaaacagccatttctccatttgtaccagcaacactaaacaataatagcaagttatagaaaataatagcaagttaagccaaagtactcaagtaactaattaacagtagctctgtttaagttttctggttaatgaaacaatttcaggtataatctaaaaagattttttaaaattctgaagagatagtacaaggtggtggttaagagcatgggccctggaatcactgtatgcttgaacttgggcaagttaatctctgtctcatttttctcatctacaaaattatatttataataatgtctttcttatagtactgttatgaggattaaatgaaatgcttagagaaatgtctgacacatacataaatactgaaatattgtaattaaaaattgtaataacactactttgtgtgactgtcaagaggatggcaatatagtattcagtatctactctaaggcttcaaagaaagtcccataaataaaaacatttataacaattaaaaaataattcagactagaatatatttctaaatgatttattctaatccctttattttataaatgctgagtaagacaaaatcatagtgactaacacctagaaacatgaaggcacttagagatagtaggtaactttatgggtagaatccttggcagattgttgattgtaactcagatcactgacttcccattctctgttccctctgtttatatcacactgtctttttcagagattgcttagtcaacatggcttgacttaaaaacacataccccctttctgatgtaaccatatattaagaaacttggaaattttgaattgaagcatatttttattcagtttttctccctctttatttagtcgaaattctacattcacgcaggaaggaacccggttacgaccatcttcagttggtcatttggtagaccatatggttcatacttccccaagcgaagtgtttgtaaatcagagatctccgtcatcaacacaagctaatagcattgttctggaatcatcaccgtaagagcttttttattttgcttcctctgtattttcaaatgccccaaattgctttacttaaaataatctgggaaattaggatattcgatacaagattttaattatgcaacttttcaaaatgtgtatgtttgcaattatgctcatttgttcctgagagttcttgttgcctctccctccccgacccagtcactatgttgttattttgttgacttagacagttcttcagtttttagtatataaactcaaatatttctgcagatgatgtagcactctggtcaaggaggagggtagttaaagcagagtttccttaatatttttaaaggaaaagaaccataagtatgagtaaaaagtgttgagaaaattaaaatacttacaagatatgtagataggtaagaagattttttaatttacctatgtagataggtaagaagatttatttcttgagaaggagaaattggtgtaagatatagtgagtgcgatcaggggtaaagagtgggcccaagagtggtaggtggaagagagtacaggtgtagggtcatgtttgtccctgggtagggtaaaccaaggaagactggctgagctatcaaaacaagtaggagttcagcctgcgtgatgtatatcttggtaaaacattttgattgtgtgtatatattattaaaaatggagaaataggacagatacacactgtacaatgatacctgtggggaattagttggcaagaaataggattgatgggagatttaatattttattactttagaagttataattctaaactttccagttgatttttaataattatatatgttctaatttgaaaactttaaaaagtatagtaattaaggacatgattgaaatattgatttgatttttaaaattacatacttctgtgacataaaaatgaatcatatgcaggaatcaaaaagcctaattattacaaaccaaaaccaatataattcttgaggcctaacaaaattatctttatctatttttaaagggccttttccaaagaaagacatataaacgcaattgaatatttccacatgtaaattttttttttttgagatggagtctcgctctttcacccaggcgggagtgcagtggcgctatctcggctcactgcaagctctgcctcccgggttcacgccattctcctgcctcaacctcccgagtagctgagactacaggcgccagccaccactcccggctaattttgtgtatctttagtagagatggggtttcaccgtgttagccaggatggtctcgatctcctgacctcgtgattcgcccacctcggcctcccaaagtgctgggattccaggcgtgagcccccgcgcccggcctcacatgtaaattttatagattcacaaacccccaaatcacttgctgatatggtttggctctgtgtcctcacccagatctcaccttgaattgtaatctccaggtgtcaagggcaggaccaggtaaaggtagttgaatcatgggggtcatttctcccatgctgttcttgtgataatgaatgagtctcacaagatctgatggttttataagtgtctggcatttcccctgcatgcactcattttctctcctgccgccctgtgaagaggtgccttccaccatgattgtaaatttcctgaggcctccccagccatgtgtaactgtgagtcaattaaacctcttttgtttataaactacccagtctcaggtatttcttcatagcagcatgagaatggactaatacatttgccatctcaaaacacctttattctactttcctgacttgagtggagaagcgagttcagggtagcttggaactgtgaagagtttttgcttcttctctcttgtgcacaagaatataaaatgcttggagccttctccttggacatatattttataaggtttatgtgtttgtattccattttgaatctatattactgcatttgacattcaaccagtttttaaccttaagaataatgagagagttctgaaaagataagcttaataataataacttacttagttgcttacagtcacttttacataaattatctcactgttctattcaggagaattcagtgaaataggaaagatatgtaatatccattttatagataagaaagccacacttagaacacttgtcccaatttacagaacagaaactcgggctttctgtagcatgagaatcagccaggagaactttgtatccccaacaagatgttatagatgttttttgatttgcaatttagataaaatactttgcagcttggaatccatagatttcagtttttctgttgtccaaatgtgaaaagaatttaaatgatgtattggattaagcacagaacatttcaacatgtaatgaaatagattttttttaaggtttttcacatatacctttttttaattgtcagataaaatcatcttaccaattatttatttaagtgagtacaggaggttgcttatactgtttagaataaagttaccatttataggctaaggataaagtaaaggagaccacagtctacaacacagcatgtgaattggatggttaaatttattagcatacaaatttctaaaggcggcaacagagagctgcattaactgcaaaataagctttttttcactgctgttgttgaagcatttataagaaaatttaaagctcagtggactgaaataaattgtgcacattttttcacacatcttgattgacatttctaacaaacttttgctactatgtgacaatatattgctctgctaccagcatagtacactcgaatataacattttcattatttaccctccacttaacattttccaaaatgtcagattgccaagtgtggtggtgtgcacctgttgtcccagcttactcaggaggctgaggcagaaggatcactagagcccaggagttcgaggatgtattgctccatgatggtgcctgtggatagtcactgcacctcagcctggacaatacagcaagacaccatcttttaaaaaccaaaaccaaaaaaaaaaaaaggtcagagtttaagataagcaagttatttttggtaaaaagccccaatatgaatgttgggcatttggaacacttttagaattatattgccatctttcctttctcttaacaaccgaaagttaacacgaatagtacttttttttaaatgtgggataatttttttttttttttttttttgagacaaagtctcactctgtcgcccaggctggagtgcagtggcacaatcttggctcactgcaagctctacctcccgggttcacgccattctcctgccttagcctcccgagtagctgggactacaggcgcccgtcaccacacccggctaattttttgtgtttttagtagagaccaggtttcaccgtgttagccaggatagtctcgatctcctgaccttgtgatccacccacctcggcctcccaaagtgctgggattacaggcatgagccaccatgcctggctaatgtgggtaaattttttatgtgggtaaactgtgtacagtatgtgttttgagccctggtgccccctcctttagtacattttaggcaaattattggttttaaatatgttaaaacaattgagttagaaatgttatcaattaaagttaaatatggatgtatataagccctgatatttactaatcttgctttctgttcattaaaatataagtgatttgtgttagaatttaaaatatagcagtattaccatttataaccaaaaaaagggatttaaaatagtcatattctggatatattctgataagttctgggagttctgttgaggcctcagatactgacaggggtgggggatgcttattagcatttatctgttttataaattggcttctgagaaacttttttttttttagaaaaagattccactgccacaaaaagtttggaaacctctgatttaaaacaactttcctcctttttgcagttactttgttttagatgcaactatatatcatagtgtttacgagcacaagctctggattcagactaggtttaaaacgtggttccactacttctaattaggtgacctttggtgagttattttatctccgtaagcctgtttcctcactgttaaaaaacagggtgataataatatctacctcaaagagttgctataagcatataataattatatagcttttttcagttaagctcttgggatatattccaacaacttttaatatattatcaacagtttgtctggatatttgaagtgtgagcatctggttgaagacagtgaagaattctccagattctcaactttattcttacattcctaatcacaagatattctagacagacttcataatccagaagtggctttttgtttgtttgtttatttagggacagggtcttgctctgttgcctaggctggagtgcagtggtgtaatcaccgctcactgcagcctagacctcctgggctcaagtaatcctcccacctcagcctcccaagtagctgagactgcaggagcatgacaccatgcccagctaatttttgtatttcttgtggaaacagggttgcatcatgttgcccaagctggtcttgaactcctgggctctagtgatccacctgcctcagcctcccaagttgtttgggaggattacaggtgtgagccaccgtgcctggccatcctcaagtgttaaatccagttccccgagccattctttcctggactattccattctagtcttatctaatgaatctccgcagctttgtctatacctcttcagttccttttgcttggtcttcaaagctttgcctttcctccacccctctcagctactggcactgatgatttccatctacaactcagttgtccccaattcctattccagtcttgatcaagtctagcaatatattgtgaactcttcaaatactaggctattctaggacaaggaagtaaaaaaatcgaaggtttgaatagaaggagatatcaagccatggggacttagagaatgtaacatattagatgctgttgtattcatggcttcaagactaattacaggtccccggacactgtagctgcagtatgcttacctaccattcatctctggctaaaggctctgtcacttgcacttgggagctaagggcagacaccttgagtttggttgaaaccaagaatctcaggttgctgggaggcttattctggaatagattcctactgttaaaatcacatgacattgtcagttctattcttagatattactcatatccctgatagtttacacgagctttttaaagtgccttgtgcgttaattggtaatcaacctgaagtgacatttactttgaaacactgtcattatcagaataaagtagccaaagtgttaagaagcctgaattttgaatcagaattttatctgtatctaatgtaatataagtagagtataagttgggttaaatgcgtaattgaagactagaataacagtagtggttatagttaaataagacatgttctcttgatctacatcttagaaaataagggtttgtttttttctttaagagacagggtctctttgtctcccaggctggggcatagtggcgcaattatagctcaccacagcctcaaactactgttcttgaatgatcttcccatttcagcatcctgagtagctgggactacaggtatacaccaccatccccagtttatttttttaaaaaaattttttgtagagatggtgtcttgctatgttggccaggctggaaaataagagttttttaaagagccatcaatttctggcacatttgtattagtgtctaacaagaatatagtttttgttttctagtctattggaataaattttatgcttctgtgacagatttctatgtacaattgtgcctttaccgttttttaaaaaaaattcatgattttcaagggttgttcatttttcttttttaaaagtaataaaataatcccttcaggattgcatttttttctcactttccctaactcagatcttttccagctcccttccttaaagccagtaaatgctggccttctttgaaaattaaaggtctctttcttgagggtaccagctgtaatttctgacagggctgtgtttcactatgctgcctggttattctccaaattgcatcatgtctcttcattctcttatacttggcagatttttgtgtgtgtgcacttagaaatagtattgtttttaagaattggactgtttcatgacattatttttaatgtatcatttctaattataatgcaaggtttacctatgaaaatcatcttcctagataactgtttaagtaataaatatatatgatagctgtacaatagaaatgaagaagaaagttattcattaaagtaaattgaattaatattcttggagtatgtcttttaaaaaatgtaattgataacctttgcccaatatttgaatttcaggagtctgtgttgacatccttgattacttttatagacttcagagtgtgtgtgtgtgtgtgtgtgtgtgtatagagtttggttgtgtatgtatacagtttggttattgaaattagaagtatagaaaagggaaacagttacagggattactgtgagagtacataattaaattataagagctccctagactaacctaaccctctgcagcagtcaggcatatggagagcctgtctgccactctctgaaaagttactttaataagaaagttacataagacagtgagaaggcaggtagctctgtcctgaaatccaaagttttactgtcctttcgtcttcatcttaatctatacttcattctcctcaccttttccttataatttggcttaaatcccaacctcagcatttatacttgggctcttttcctatctgtatcttcctgcttgatttgattgtttaaaaagaggttaaaagaggttattctcaaatacctgtagtcttgcaagtagcacgggatggagatttgtgtagattatagagctcatgctgcatctaaagacagcagctgccacttggctttatacagtgtttgacaactggtactgcaggcccattctttccggagcttccagatttttcatcttgaaaatctagatttgtatgcaattttaaaaatgtaattgtttaactcaattatttttataaaaacaatgaatggtccaaatgtatgttggccaaaattggcccataatccatgaatttataactgctcttttaggacaataatgtctaatcataattgcgcaataaaaaccacctctggaggtgtttcttgtaaccccagaagtagagattcaacagttttagcaaaatgtaccatagaatcagtgctgtccctctcatgtaactgagtattgccactgttaggcccatactgagtatgccactgttaggcataactgagtattgccaccgataggcccatacaggtttggctcacttagatataccactgctgatcaggcttgagtttctcctgtatattttggtgctgtatttaaactgatagctggaccaagaataaggaaggtttccctgactccattttcatatgttctccaccttactccctttcccacaggcttttagttttaaattttttttctcagcttttaaatttagcttttaaatgtttcctggttatgacaactgtatgcaaagcagaaagagtttctaattatattgcctaagtggttacacttaggtccaagtaaggggtgagacctgttatatatgtcgagtccaattacttctggtatttgtaaagttttagagattcttatcaactgccttttaaaaatgttgcatctcttaagttctgctaagggatgtccatctctgtgtgctctaatcctatgtagtaggccgtggttgagttacatatctctattctaatccatggaaacatttccctagacaagcaatacttgaatctatgggcccttagaagcttgtattcttggcagttgaaagtaacataagaactaccacatttgggagctggaagccctggccattaaggcagacctcaatgaagctttggctgaaaaagagggatgtatgctctgatgcagtctttgtagacttggcagaatttagagcatttgtgccctgaagtatttctatgcagacatctaggctaagtgggcattgctgttcacttgcttcttttgcagttatattttataccatgttataaaatttcagaaagactctaatctctcctaggagaaacttctctttaagaccatacaatcacatcattcattattaatcccagctgacttccttggcactgatcatactttctttcagtttcacaacacttatttactaggtgtctagcagccaacctctcaataagcttacacctcctctacaagggagaacagatgtatccaagggtcactctggcagtaaatctctgtatcagttatcttgttatgcttgatcacaaatgagcctaacttaaagagacataacaaaagttctttctttcttacattgtatgtacattatgtgtcatctgtggctgtgctctaccttatcttcattctgggtcccagactggtagcattccctgtttgggacatggctagtctcatgggcaagggaaaaaagaagcataatgaaatcataagctgtttcatttttttctttttttttttttttttttttttgagatggagtcttgctctgtcgcccaagttggagtgcagtggcgcgatcttggctcactgcaagctccgcctcccaggttcacgccattctcctgcctcagcccccccgagtagctgggactacaggcgcctgccaccatgcctagctaatttttttgtatttttagtagagacagggtttcaccatgttagccaggataggatggtctcaatctcctgacctcgtgatccgcccaccccggcctcccaaagtgctgggattacaggcatgagccactgtgcccagcccataaactgtttcttaaagcttcctttcaaaagttacacattccacttctacccacatgtcattggccaaagcaagtcacatggccaggcctaatgtcagtggggggaagaagaactttttttttaatgataatatcatctaatacattttccttatctccagaccttatagcttggatgttaggtgtcccgttagtcaacagaagagcagatactaggtataaaatgtgtgcttcagtgccacatcagcagccatgtggcttgacacagtagctgtcatctctcttatacctgtccttaggcaataagacagtaattcttttatcagataataacgccaatagtggtcagtgttcttatcaagaacaattttccgcttacctatttaatcttttacttctcccaaatccacgacttctgtggatgcatacttcttaagacacaagttgaaccacaagtttctacttttggcctttgtggaatgctcacaagtaatgtttttatacattttatgcttgttaaaagctagagtttctgacctgaagttacctttatcatatctagctctttttatcaattcctgttgccacaaattgaggcttatgctctctaatgttaattggattttgttttctcaccttaaatcatatgttctgacaatatctcaaccagttttggctctggtgatgatctcagcactcttactcagatttccaatcctcactgcatcattgaattcattacttccatgaatcgtattttatttctaaatagattaggccaatctcttaagctatttaggctggaatagttactttatctgtggaactacccaattatcagttctggattttcttgcctaccttattcctggctacccgtgactcctctgacaaccttaaaaaaatttttttggaaagatgtttactttgttataatagattaataggtatcttcacaggaataccttgataatatattttattatataattgtttataaatttgataaagtaggaaattagatttattacttcaaagttaggaaaattttcattaaaaagtggcacttccaaataaatatggtatttagagcctgtctcctaccagacattgtaaatatgtgggttgcttgaccctaacttttaaaaaagttatgaaacaacttccaaatttgttttcttgtctagatcacaagagacccctggagatgggaagcctccagctttaccacccaaacagtcaaagaaaaacagttggaaccaaattcattattcacattcgcaacaagatctagaaagtcatattaatgaaacatttgatattccatcttctcctgaaaaacccactgtaagtagcttcttcagatattctcatttttatttgaatttttaaaatcctaaatgaaatttcttttgtactttggcagtttttagttgtaagttgtattacagtaccttctctttttcatcatattctttggtcctgaattgtgccatgatgtatctcaatataagttctataattagaagtgatcatggagtacatagagtatataattaaataagctgtggggttaagggaagattcctataagagatcatctctgataagaactagtcagattttttccttcaaagagcaggcatagaacatactgaacaaacctgcatgttgtgcacatgtaccctaaaacttaaagtataataataataaaaattaaaaataaaaataacaataaagaacatactgaatgaaagaagcccaggacaaatagccatgtgttgtaggatttcatatatgtgaaatatccaaaacagtcagatctgtcaagagacagtaagtagatttgtggttgactaggctttggaggatggcaggtgggaaaatggggaacgactgctaatggatacaagatttcttttggaattgatgaaaatattctaaaattagataatagtgatgtttgtacacctctgtgacaagagtaaaaattatggaaatatacactttaaataggtgaatgatatgtgaattatatctcaataaagctgttttttaaaatcacatatatcaagcagtggaagtatcatttgaattcatgtaacacttatgagcaccctctgtatactcatacatatgaacctggcttgctatgagccagattctacggatatagcaattaataaagacagacatggcccctgttcctcctgtcacttaatagtctagcatatgctcgtaagaatgcatgagaggatatatctggttgggctaactgcaagttattagtcaaagaatttactcttctgaactaaaatttttattagaattatgattttttacaaactatgcataatataagcatacaaaaaatatgcttcctatatatctgaagaatagattttaagtgaagaaaattacaagttatttaattttgtctttttaagcctaatggtggtattccacatgataatcttgtcctaatcagaatgaaacctgatgaaaatgggaggtttggattcaatgtaaaggtaatctggaatttattttatactcagtttttaaattaagatgttcttattttggtaatatttgactaacattttacttattctctttttaagggaggatatgatcagaagatgcctgtgattgtgtctcgagtagcaccaggaacacctgtgagttatctaaatgtttcaaataaatcctgttttcaagaatatgtacttattttataattcttactagtttaaataaaacaaggaatttcatcatttcttttatttatcaagtgtcaaatgttggctgaatctctttaagttgctgggaagttagttttgacttgttctctgtaagtatttaaaatccctgtttttataaagaagctatttatgactttcattgcttctaaagcattaacagattctatcaaaataacccccttaaaaaacaaaatatagacagaggtatagtttcgtgggggtttttgtttgcttgtttattttttattagagtaatttaagtacattatacttgcctatgcactcctttaaaattttactttaaatggaaatgatactacaaggataatttttaaaactttttattatgaacattctaaacaaaagtagagaaaacttatatatccattatgatgaatctcctattactcattgttcagcttccacaatcatgaactttctgttcatcataggacaattcttaactaattgtaggtacatcatctttattactgttttatataacaagtattgctttcaaattcctatttatgttgtctactctgtttactttcctttttcttacctaaatgatcttcaagcaccttttatcatttaactgtctctctgttctaggaaaggtatgaaccagcagcctgagagagggaggccagctatgctttttttggtgctttgcagcaacctcaaagttggtttgaaaatcacaattgagattgatcaaggatatcatgttatgtggttttggttctggtttttaaggaccttgttttttgcgaaaataacagggtactcatggaatacccctggcatgagcataaacacagaatagtttatttaaatataaatacatcagatagctattgaggtgtcacacaaaactaaagagcatgaatgcaatcacacctctacaggaaacttttaaaatcatcgacttttctgcttttcatctgtttctttttatgtgattgtttgattcctctcagtgtgaatgaatttgtacattgaatcagcctacctctcaagccactccagataaacactccagtctaagtaaaaacagtgtacttagtagcagcttcaagcagagttttgtaacaccactaccacacacacacacacacacacacacacacatcagattgtgactcctaagtctccactaaatagaaattgtgtaactacctactgctattgtgatcctcaatccatgtagtaggatgtgactactaataacttccaggtttgtatattaccagctcagtagcccacagggacctctcagtctaaattataaactcctgggatgtaaacccttaatagacccagcgtggatcctatttccttatttgaaaaaagtccgttgtgactgggggacaagaccggggatattatgtataaaatgactcctggggacatactattaatatgtatgtaaaagatggggacaaagatggtagagataatccaaaattatttattttatatatatttgatgggaaatatgaatatgattgggactgcagatgaagggatgaaggattgatgaattatctatcatgtacaaagttaatagataatatctaaaacagaaaagaataacaatagagagatgttagagatgcagaggtaaatacagaaagatatatctaaagtgttgaaaaaagttgcctctagagatggggaggtggtagggaggaacacaaatagtttcttaacagtcttataaacctagtcaaatcttttaatggtgtgatttataactttgctaaaaacaaaaatttaagacttaaaaaaaaagcagttgtatatcttttggcctgacagtttcacatttaggaatttctcctaatgaaatagtttgactagggaacaaagagtacttacacagggatattaattatatggtttataacagtttaaagtggaaaaataatcaaatgtggactagggaacaaagaaatacaaggatattaattacagtatggtttctaacagtttaaaatgaaaaataatcaaaatgctcatcgttaaagttggggaaacaagttatatgttgctttgtgtctattgagatggtaatgtaactatataaatatggaaatatatccatacgatggcattatggaaaaatatataatttcacatatatgtttgaaccagtttattaaaatattagatacatagaaaaattctggaaacgtgctaaaaaagttaacagtgggtaatggaattacaggtattctgtatttttttaattgtctggatcatgacaatgagcatatattgctcttataattagaaaagataatacacatttctttatttacatgacagttgtaatagtcaatgactcacacgcataaaaaaagtattcatttttctgagcaatgaatatggatagttttcaattaagtcaaggattcagagaatattctatagatatattcatttccaaacagaattctaagactgttaagttctctttttaatctgtacatattgttggtaatttttcccttctgccatgtagaactatgttccataaatattggctggaatttagagcaaattaaaacatagtcattctattgggggaaaaaattaaaacaataggaatttattatttttgtattattttgttaatttagagatcaccacaaccttctaattggaaaccacagtttaggcaatcgggggaaaaggaaaaggtttctgtttttgtatgaatacataatagttgtacatgtttatgggattcaaatattttattgtcattttttatattggacatcttctgaaatggataaaacaactcccaattaaagttatgattctctttctgtttgataatcttagccaaaagccgttgctgcaacaaaactcattttaacgtagtttattggccgggtgtgatgctcatgcctataatcttagcactttgggaggctaagatgggaggattgtttgagctcaggagttgaagactaccctgggcaacatagtgaagctttgtttctacaaaaaaaatttttaaattcaccagatatggtggcacacgcctgtgatgccagctactccagtggctgaagtgggaggatcacttgagcccaggagatcgaggctgtagtgagctatgatcacaccactacactccagcctaagcaacagagcaagaccctgtctcaaatatatagcaagaccctgtctgaaatacacacacacacacacacagagcaagaccctcaaacatatatttgagcaagacagggtcttgctctgtatgtgtgtatatatacacacaaacagtttatttagacttgtcagatcagaatgaaatggaaatgaaaaattgtaacatatctgacaaaaggcatattaactataagagagttccctttagtgataatggatacagtaagagattcatagctatcctctttaacacatagaccacctctttttttctgccaactacactatgcacaaaataatgtgaggaaaagctctgtctgctatagcccattattacattttccccagtaccattggctcccaattcactatacttcaggtatctcaaagacatttacaaaaacttggaactaattggtatacaaaagcatcatactgctagtgcacagagggaatatatgaatgtctgtcatctacttcactacataagtagacaaaaaagcaacttgagagaatgagcataactctaaatttgaacgttccagattttaaagctttgggttgaattatctcatcttcacaacaactctaagaaataatcagaacttttcattttcagatgtcttttcagaacttcagatgtctaattaatcattcatttcagaagcagcagagtaacttctagaccagtgttttttccactaatgacagtgccttattggattttattgactttgtgttgataaagaatttcagtagttgtgcttttatttcttcatgcctttaccacaagcagttcccttttttgtaagatccaaccccatcatttccttctcaacctggcctatcattcctcaaaattcactctcatatgttttcattgctatgttcccagaacatgtccatatttctatttcttttgtctcttttaccttaatcgctgtttgtcttctcactttgtgctatagtgcaagactataaaaatgaccatgcaagatgaaattgtgcaggatcttgatgattaataggaaaaattatggttgttcccatgacctttaaatttattgtcaaaacattaagaatttcctttactgtctcttataaaggtaaaaggaaatgaaaaaaatagtaaagctaatataggattttgtatcctgtaattcaaaacattagaaacactgagaatttaaatgttttattttcttgtgaaaactcattatgagtagtttaaacggtgcttgcctcctccccgtggtacagcttagaataccaaatgagcttcatttcttgccttggcaaattgtcataatactgtctacttgacacactttcagtactttgtcctctgaacttttgatgttgtgaaatatctccaaaagttcctttggctgcatatctagagtctctccaacaacagtgttaacattcccatggtcatctattgcttctctgactctatttatggtccattcaaacttcacctccagcattattcactttgctgcactttcatcttttgtgatcaatttcctctttagatttaggttattcattttaatatgggtttatcactgggagactaggaggcagcccaactacatgctttcctgtctgcacttgaactgaaaacagatgaccatcagactttggaagaactgatgtgactggccactgatgatgatgtgtgtctattatttatgtagtgatttttgtgtactttttacagttattcacggtaaatgcactgtggtaactaaagtttgaattgtattgttgggggactgctgttatttaattaaatcatggtaactgaagtttgtatgtatctagacagtgtaaagctaaagctacttgtgtgtatgtacttggaaatcatcagtcttatttgtaggtctaggcacataataggtcatcaggaaagaaattgttgcatgaagaaggaacaaaaatactctctctggcaaagctagatttctacattttttaaatagataataaatgaaagatgcttttctatatgtagtttagttctcctgctattgggtctattaaaataaattcctgtgctctactttcagaaagttgcatgccaatctgaaaccttatctatattatattacaggctgacctctgtgtccctagactgaatgaaggggaccaagttgtactgatcaatggtcgggacattgcagaacacactcatgatcaggttgtgctgtttattaaagctagttgtgagagacattctggggaactcatgcttctagttcgacctaatggtgagtactctatgtagtaccagataatttatagtaatttattactgttcattactgagcacagcagccagatttctgacataaaacataagtcacctaagtttcctgctcaaagcacagtggctttcattgacacgtggagcagaattcaagttctttgcccccccaccccttgctcccactcagccttgcttactttcctctattctacactagctttcttgcagttactcagatcttccaatctaatcgacttattagggtttttatccttgctgttccctgtgctgacatactctttttgattttgttatgacttatacctatacttcattcaggtctctgctcagatatcatcttcagaagggctttctctcctgactaccatagctaaaatggtctcccatttcccctaaatggtaatagttgtagtactagtactcaataaatactagttgaatgaatgagtaaatttgaactctgttccacttttagaaaatgccataacaagctatagttaaagtgtttttaaaatactgcctttgttttcagtatatgatgtctacttgcctaatcatgtcatctcccaatctggacagctgacttgttaattcatagtcatagaattccaggtttggagaaaacttgaatgccgtaagctctagctctttggctaattgcacgaatttcctccacaacaacctcaagaacattctaccaatatagatagagcactttgtggctcctgaaacaggtcattccatctttggatagctcaaactataaattgaactaaaagtccatctttcttcagtcctgctcctaagtctgtcactctgtgctatgcattataagtttaaccccctttccttcagttttttgacaatagctaattttaccagaaacccacctccctttctccagtttaagagtcctagagtcttcagccagtgttcatatggcattgtttagagttccctcaacactttatcagtctgctctaagaaaaaagttttatatgtctaatatcccaggattagacatattcttctggttttgttctatacaatttactattaatcattattttagccacagaataattattgttaatgccatattaccacttgaatatgtaccataggaaagtgaaatatcattcgaattctacttgtcaccaccacacccaaccctgcaaaattttgcaaggatatttcttttttgtaaacaaaaaataaaaaatcctctttgtacctcttgttcacaaataggcgttttcattttatcttctccactttgtgttcttttccattaatggtctagaattggctttctaggaagattaaaaggacttcaacagaacattctattttgacttttcaaggaacttgttcatttagacttgatacttaggtgagtcattaggtgttttctgtcacatacagctacttaaattttaaaccaggaataacatttttttctgtatttattgtattatattttctcttgataatagatcctaaagaactcaataatattagctaatagttattaaaaactttctgtgcacctaggctcttttgtatattttcatttaatcctcatagacatccaatgagattgatgaattatccccattctagagctgaagatactttgacaccaagacattcagttacctgctcacagattcatgacgccacagagccagaatatgaacaaaaatccatatgatggcaaagacccagcctttttacaattccagatctcatccttttgctttatagtatgagaggaacccaccagggtctacttcttgcaaaatatctttctaaattgtttcatagtcaaaatacggagcagaacctgcatctgttttcagtgtgggtctgtcttttccattcttaaagtttcatataattaaaatttaaaactgtgtttgccaagaatatatttttgtttttctgatcttttctcctttaattcttatttcttcttaggcaaaatgttgtcatacctttttgtcttttcattcttcatttcagaaatttatttttctaaaaaaatgtatagatattcaaggaggaaccagatctcttaggcaagggtaaagaggcccctaccttggctccatgttttagaaggccctgctttggctctctttcttctcccagtggagtcataattttataggaccaaaaggacatgccaagctgtaacctcccttccctttctataccactttttttcaaacctcagttctgggtccagataaccctgagcctctccagatcttcatgggtattttccacacatccgttctctcaaggtgggttcacatggtgtgtgtatcctagcccagaaggtggctaagaggctacagtttgtggagggacaggtatagatatatcttgcatgtgggctgggatcttcacatgtatgtttataagcccctatgttaaaaaatgggactgagagtgggtaacggtagaatacaggcctaggatctagggtctgaatctcctcacattaccatgaccatgaattctggcctagaattctcatttatagtctggcctcccaggttgttttgtagatacatcacagaaagaggatgaagcatattttgtttagcactgtgttcaagttttttgtaacttctcatagttaaacatatggtatataggtctctatttgtactcttgccctaggtcccctacaaattaagagcgggtgtattcacagctgcttctcagcagctcttctttcttactgtctcttcaagttatagacattttcagcaatgtagccaagaacacttcttccctccaaaggtacagcaaagcccctcaactccacaactagtttctgtccccccatagtgacaccagactcagatctggtgtaattcttcacaaatgaattattttttgaacaaaacattatacagtgtatctggtaaattcctatcgtgtgaattcattaagatttccacgttttggggtttgtttgattttttttttttagctgtatatgatgtagtggaagaaaagctagaaaatgagccagatttccagtatattcctgagaaagccccactagatagtgtgcatcaggatgaccattccctgcgggagtcaatgatccagctagctgaggggcttatcactggaacagtcctgacacagtttgatgtaagtaatatcattatatattaaaagcattttgctgatatttgctaactagtttcatagtttcttaagtgcctaatctgtgcattataatttctaaactaaaatgatattctgagaaatgtttgacataaagagttctaaaatgccaagttttaaaaattgctcccaaaatactagctatggttatataaatagaatatgttttaaaaagagggataaggaaattttatacatatgtcatcaaactaaatttttttctatagttaaatagctgtttttttgaaaggtggcagatgaagataggctattatatactttaaaatcctgagcttggccaggtgtggtggctcacgcctgtaatcccagcactttgggaggccgaggcgggcggatcacaaggtcaggagatcaagacaatcctggccaacacggtgaaaccccgtctctactaaaaatacaaaaaattagccgggtgtggtggcaggtgcctgtagtcccagctactcaggaggctgaggcaggagaatggcgtgaacctgggaggcagagcttgcagtgagctgagatcgcgccactgcactccagcctgggcgacagagtgagactccatctcaaaaaaataataaataaataaataaataaataaataaataaataaataaaatcctgagctaaaggaaaataacttttatttttgaagtttataccttgtcatttaatctttgtttatttttcattggtgcaatcttgaaaactggaaaaaccaaaactttcagacagatcattatatccaatgaactagaatgcttcttcagtgcttataatgtgcattttgacccacgatcacccagtggattttgaaatgttttattcagactatatcaacctaatttgtttaaattaataaacctgaatttttttttttttttttttttttgagaagcggcctctcactatgttgcctaggctgatctcaaattcctatgtccaaacaatcctccagcctcagcctctcaagtagctggaattacaggcatgcacagccatgctaggctccctggatagtttttaatgtgtttttagaaatgaccatcattaatatttgttgttctgacatatatgttataggtaagtgtttaactataaaacatttaggatatgtctgtttttgttcaaaagttcttagttcatagactgtaaacacctccaaactaaatgaaagttaaatgttttctgcagatttgctactcacaacttcaggtgctcctgctgtaagcagaattggtttcactagttttaccacttttcaaaatatgacacataatttatgttagaaactgaagaattcagctttgcaaatctggttcagtactctactagactatggtatatcattgtatagatgacctattcaaaggcaaagaaacctgtttcctgttagtgtagaaacaagtctggtaaacaaaagagaaattgtttatggcttttgttggaattgtaccttttttttttttttttagcaactgtatcggaaaaaacctggaatgacaatgtcctgtgccaaattacctcagaatatttccaaaaatagatacagagatatttcgccttgtaagtatcttattgtctctgttaaatttaatcttttaaacataactttactaaaacattatttcttttaaatttttttagatgatgccacacgggtcattttaaaaggtaatgaagactacatcaatgcgaactatataaatgtaagtttattcttattatgcctttgccatttggaaaaatacgagccactatgaactttgaggttctttttgttaaaatcctgacctggatagaatattaaaactttcagctatgaaaaatattattgaagtaatattaaagaaaatattttggtacttgtgtattaatacaggtagagcagtggaatggaatagtccagttcataaatagacttagatactagaattttgtttatggtagaggtggccttttagatcattggagatagactatccagtgaatgggtggttgggtcaactgtctagaacaggagcccccaacccctgggccatggaccagtaattgtctaggttgcatgctcattatgaaaatctaatgcctgatgatctgtggtggaacagtttcatcctgtaaccatccccacctcccaccctcccaaccccactccatggaaaaattgtcttccaagaaaccagtccctggtgccaaaaaggttggggaccactagtctagaatacgtcattgtaaagaggcatttttttttcttacctggaaaaaaaaattactatttttttcttaactctgtaattagaaaatttcaaatgtacaaaattaaagcaaaccgtaaaatcaaccttcatgtacacatcactcagtttcagcacttgtcaactgatgacaaacttggtttcacctttaccaggttcttttgaagcagatctttatatcatatcgttcatctataaatactttacctctactcactcttgatgccaacatgtatttcaaatatatcaaaatgtaatttttaaagtggaattatgaaattatttgaaggaaatatgtgaaaattgtttaaaatctcaaggggaggttttttaagcttagatacatgtctaagcttaaagagatgaatttgacaaggtaaaatttgttatttttggtatgcttaaaaactactaaaatcaaatgacaaatggaattttttaaatactagaaaaagcttatttaatatacaaagagcttcataaatgaataagaaaagtaagcctcggcaacatattgagaccccatttctcgaataaaaataaaaatataaaaatataaaaattagcagtcatggtggtgcatgcctgttgtcccagctactcaggagactgaggtgggagaattgcttgagcctgagaggttgaggctgcagtgagccatgatcacatgactgtcactgggtgacagaacaagacccgtctaaaaaaaaaaaaaagaacaatgaaaataatggatgaaggacatgcaaagacaattcatagaaaaggaaattatgcaaatgacatttttaatagtcatttttaaatttatacaaaagtagagagaatagtataaaagagtccccccatacctcttacgcagtttcaagagctatcaactagtggccaatcttagctaaatactaacctccaaattatttttaagcccaaatatatcactgtatatgtcagttgagttaattctcaccattcgatgttgtcatgctctagaaagtctttgtacatgctaaattagagactatttaatcattgcttctagggaaaatacagggttaggttcccccaggccaaaagtcacaacattttaattagctgatcaatacatactgttgtttctgtttaaagacactttatttaatatatagtgctgattcattaacatttaactcatagtcaacagcactataactcatgcctcaaggaagcttatctaacacacatattttctccatgaggtatatcacatccttcttgcacttagaaacactagtcagcactttaaaactacacttgggggtcagttttaaacagcaaaatcaccagtaaaaaaacccaaaaggtaaaaagtaaggcactacatagaatgcaaaaaggccacttgtttacagtatgagagctaaaacaaaatgagttggtttgtttgatctcacctggaaatgtgcatgtcttcagatgactcaaatttttcactgctctaagtatgtctactagatgaccaagaaatccctgcagctgttttgagggttatgaataaattttagcaagtagtcaaatttgcaaatagagaatccttgatggaggattagctacttaggaatatatctctgataaggcctttttttttttggtagcaaaaccacaatactattttaacacttagaaaaataatatcagagttaaatgaaaaatacgtgcagtttacaaaaagaaaagtgcaaatgaaaacttcaaggaattactatttcacctgagattgaaagagcaaaagtttggtaatactacatgtaggtccacatcctttatgtgaaaccttaggttaaatatactatggggccaggcgcagtagcgcattcctgtaatcccagcactaaagagaggcataagctggaggatagcttcagcccaggagtttgagacctgcctaggcaacattaggaagacctcattctccacataaaggggcagtgagtgggagggtgtagaaaaatatgctttgggattccgaatttttggaattttgaaagggtatttagtacatatactataataagtagcatcgctggcaggctatgggacaagtgctccataatcaatatatctgaatagttaacagcaaactatagatattctccctaagtaagactaataaagagtgcaaatagtcttaggtcagttcaggtcagattttgctgtcaaatgagcacaggttggggcaagtttacagaaataaaaaacatgagggccttaaatctgcattaaatattttcttgtatatttatacagtagagccatttaaaagaatgaaattttatttactcatcaaacatcatcttgaagatgaagtaaaaaagacaagcagaacaacattatatatatagtatactaccatttttaagcaacagttttacagaaaagtgggaagttgcatatatgtttatatgttgtatatagaatatccctgagaaggctatatgacaaacagaaaaagattaccttcctggctgcaaactagaagctgaaatgggagaagagactttctttattcactctttgttattctttgaattgtcatgtgcatatatcacctttttaaaaaaaatttaatctcaaaatgtagtaggataatgactgatgactcaactttcccaaatactatcttacctctttctgaaaattatgaatttaaaatattctgataccctctaaagttactttatatgtaaaaattcaagctaaaaccaatggcagaatttttgttcctcacaaattttaccaataaactatttacagataagtattttttatttctttaccaagtctctgcctctgaaacaaaattctgtgttaagctgcttttaaaaatcataatcggccgggtgtggctcacacctgtaatctcagcactttgggaggccaaagcaggaggattgcttgagcccaggaaaatatttaaattcttatttccactaattaaaagataaatacatgtaactgttgaacattgccatgaaatttcttctacagataaaataagaaattgttaataaagatttgttttactgacggcagtttattgaggttagttgtattcactataacagttagtggatgattttcctattcctgattactgtaaaaagtaatgcaaaacattttattttcatgcccttttctttttagatggaaattccttcttccagcattataaatcagtacattgcttgtcaagggccattaccacacacttgtacagatttttggcagatgacttgggaacaaggctcctctatggttgtaatgttgaccacacaagttgaacgtggcagagtaagtcatagttgaatcttacacattgcttggacttttttcaaattatactgcacatatgtagtcaaaatattcatatttatttaagcctttgtaacctttaatcttcttttcttgtggtttcttgttttaaatcatcatgtttaagtgcataaaactgtgactaacacataaataaatgtgacataagtgttagccattactgtcattgttatttaaagggattaatatacatttgttaagggtcttgtgtctaacgtatatacagaactctacagtaaaataaataatgcaatttaaaaatgggcaatggatctgaatagacagttctccaaagaagatatacaaatggctaagaagcacacgaaaaggtgctcaacatcattatcagggagatgcagatcaaaaccttaatgagactttatatcctagaggatggccaaaataaaaaggacgtataaaaacaagttctagggatgatatggaaaaaacagaaccctcctattgtgggtttgtaaaaccatccagccattttggaaaacagtcttgtagttcctcaaagagttaaacgtcgagttggtataacttagtacttccattcctaaatccaaaagagttgaaaaggtctgtccacacaaaaatttgtacatgagcattcataacagcattatttataatggccaaaatgtagaaacaactcaaatatacaaataaaatgtggtatagtcttatggttggatattatttggcaataaaaaggaacgaagtagtgatacatactacagcatgggtaaacctggaaaacacttagcatagtgaaagaggtcaaaaagaccacatagtgtatgattgcatttatatgaaatgtccaggataggcaactctgtagagacatgaagtagatcagtggtggtctagatctggggtaaggatgggggaacggatgaggaagaatgaacaatgactactaattggtatagggtttattttgggtgtaatgggaatgttctaaaagggattgtggtgatggttgcacagttctgtgaatatactgaaaactattgtatacattaaacgagtgaacggtatggtacatgaattacttgtcattacagctgttttaaaaaatcttaagatttaatgaggatttttgctgcctcaaaatatagccagattacttactattaaaaagggaaaaaagtgacaaagaaaaaatgtcggctgggcgcagtggctcacacctgtaatcccagcactttgggagacggaggcaggtggatcacctgaggtcaggagttcgagaccagcctgaccaatatggtgaaaccccgtctctactaaaaatacaaaattagccaggcttggtggcacatgcctgtaatcccagctacttgggaggctgaggcaggagaatcgcttgaacccaggaggcagaggttgcagtgagccaagatcgtgctattgcactctagcctgggcaacaagagcaaaactccatcgcaaaaaaaaaaaacactagtcagcagatcgagatgaaatttattaaatttttcttgtaacttttatatgtttgaaatttattaaaaaaacatttttaaaaattggagaacatgaatccatatgtatataattttatttattatttatttatatcaatatcaggttaaatgtcaccaatattggccagaacccacaggcagttcatcttatggatgctaccaagttacctgccactctgaagaaggaaacactgcctatatcttcaggaagatgaccctatttaaccaagaggtaagaaggcaggatatctgttcattagaactgttgtgttcagggtaaagactgaaagctgaaaatgtttttagtttgagtattggttgctaggaaatactataagaattattgaattatttatctgctttaatggggtactttggaattttattaagagtattatcctattctattataaaattaatgtttttctttagtttctatgactaaatatgaatggtcagtgaaaaagtagtctggtaaataatactactgttactactttgcttattcagaacaactgtttagatatgtttcattataaaaaaaacttttactccaagtagtatcagtacagtatttgggtgtgtctgtggaaatggaaaaaacaattgaaagctattaaattattttccttttttaaaagagtagaggagagcaacttcacagtcccctacctattaagaaggaaaaggttgtaaccaggaccttctgacagcagatggggtgtagatttctaattgccagctcttaattttgcctgagtcagtcctcttggcttcaaatgaaactgattaataaatgatggctcagtatcccaattggaagatgtatgtagagagcgtcatgctgccagttctgtcaggctgctagagacagtgcaccctactttctctgcctgcagctagctatccccctgccaccatctttggttttgaaagggactaaaagaataactgctagagaagagcaaatagcccaagctatgagtgcccaggactatcccatcaatggtcaagcctttggaaatgagaactcccctccaaccccaagagcatgattaaaggaaaccagagagacagagtcttactgacgaaaagggaagaagccagaagttgtgctgatttatagaaaaggaatctggcattgaataaagctaaaatgacaagaattttaaaatttcaaaattttatgggctagagtccatcagaatgaatttagggtttggggacatatactgtgtagctcatggtctaatgtaacaggtcaagccaatatgatatttcttcattttctcaaatagataatgaaagataggctacgtatgtttatataaaataatgtctatctttagcatagtctctattatactccacctgtagattatccatgacagttttatataccatagtggcttttctttacacaccctgagtacattagaactaagacatgagttagtttctaaagtttgagccaaacataattgggaaaatgagttcgctcccataaatacatacatacatggatggattaatgatagcagatactacctcaagtcttgaataccttttacttttactcttcaggaagctctcttcagtgtaaatggcaataaccatagttataattatagtgttgaatgactatagcaaccatttattgagtatatggtgccaagtagctgatggggtgatttacaggtcctctcatggagtctttttagcataagactgatcctttaaagtatagatgttatttcatttttcagttgaaggaaattattttctgaaacactgaatgctgtaactggcagagtcaagatttgaaccaagatgtatctaaacgcaatactcttactgtctccgttataccaaccttggctctccaaaaagaattaatcccactgatttgactttgtgtttttattaactccaatttttaatatacatttatcttgagattttatttttctgatttccataatttcatctgcattgtgtgaggattaggtcagctttgttcacaaaaaatgttttttactttaccatttttgctcacccaagaattcattagttttttttaagcatttctctgggtcttaatttgtttctacctatgtacttgattatcatctttaaaatactttacacatatagaaattgagttataaaaagagtagtaatgtaattagccatacttaaatggatacaactatttctgtaaaatagtttctttcctttttgttgaaattttgcattttaatgagtttatacataacttttggtggagaagaggagtggttggttttgctttccttctaaaattccaatgacatgaatatattttaaagataatgtcatagtaccaacaggttcatattcctgctgtgcaataacagacgaatacactgagacagcagggatgcagcagataaagagtttaatgatcgcagggtaccgagcaaggagatgggaggagaccctcaaatcatctccccaaggagatgagatctgggatggggtttttaaggggatggtggagagcaaggggctgggaagttaagatcgttgattggttgggataaggtggatgaaatcatcaggaggtgcattctttggtgagttagcttacctcagggtcctttagaccaactgagtcagtagtttcatcagtatgcaggacccaaaagaatgtctcaaaggggaaatctaacatttcataatgtcccaagttgttatctgtagagcagttaaggggaactataatcttgtaatgggtctgtgggattctgaggcaacaggcaccaaccaactatgaggacgcgggtcagagagcagctgacctagtgatcaatgctaagtgtgctgcaagctgtgtttagttttctatctccccctcccttctttcctgatgaattttatgaggtttgtagggacaatttcaataatacataagtcaaggtgcataatttttcatttgttcttagaaaaatgaaagtcgtccactcactcagatccagtacatagcctggcctgaccatggagtccctgatgattcgagtgactttctagattttgtttgtcatgtacgaaacaagagggctggcaaggaagaacccgttgttgtccattgcaggtactctgttttccgtcttttatgagtgtatagctgaacagatacgtcatttttaaaagagagtacatattttgtccttatggtgttattgtcactgtaataattagaactcaaagctatgctctgaaggtaggaggcaaaggatatgttctaacatatgattggcagtaactttatcataagatataaaaataatactgattgcactgattcttagatgctcctccttttcatattttaacacctctgaaattggtcttaacaatttacaatagatttgatgaagtacagtactgtgggctgtcttagtccatttgtgctatgtaacaaaatattcgagactgggtaatttaaaaggaacagaaatgtatttcttatacttctggatgctgggaagttcaagatcagggtacacacaggttctcatgagggtctaatgaggactgctctctgcttccattatggcactttgttgtgtcattctctggacgggatgaatactgtttccccacatgctagaagggacagaaggggtgaacccactctctgaagtccttttatataagcgctttaatcccatcagccctcatgacttaatcacctccaaaaggtcccaccttttcttttttttcagtcggagtctcatactgtcacacaggctggagtgcaatggcatgatcacagctcactgtaacctctgcctcccaggctcaagtgatcctcctgcctcagcccccggagtagctagaggtacaggtgtaccaccaagcctggctaatttttgtatttttttgtaaagatgggtttttgccacgttgcccaggctggtctcgaactcctgggctcaagggatccacctacttcggcctcacaaagtgttgggattacaggtgtgagccaccgcgcctcaccggttccacctcctaatattatcacattggtgattaagttttaacataggaattttatgggacacattcagacaacagcttaggcattaggttacagcctaatatttagattcccttccttcttccttgcctgtggctcctcttaggacattcattgagtactcctacctctcttgaagtgaccctaccaaaggctttgctacttctaaaagctttaagtaaacagcaggctactctttctttctttgagacccaagtccccttctgccctcaaagggccaaatacagtgacttcagtctttactgctactgatccagagattaggagacagttgttcctccctattacggccacctttgttaagtgatttattcagaggatatcttgaggtatctctttatacttagactttccaacacactttaagagtagagtttcaaatcttcaaaacagattatagaccaaaatttgagaggtaaagtagcaagaatggtgaaacaccattttatatcccaagtccctgataactactgcattcgtgttcacagattagaagttaaaaagttgttcttggctatcccagtggtaaagtttaatttaaaatcagaccgggagcggtggcccatgcctggaatcccagcattctgggaggctgaggcgggcagatcacctgaggtcaggagttcgagaccagcctgacaaacatggtgaaaccctgtgtctactaaaaatacaaaaaaaattagccaggtgtggtggtgcacgtctgtaatcccagctactcgagaggctgaggcaggagaatcgcttgagcccaggaagtagaggttgcagtgagccgagatcgcaccactgcactccagcctgggcgtgagcgagattccgtctcaaaaaaaaaaaagatatatttgagtttaaaatattgttgtcttttgtgcattcgttgatggtttattattgtcattctatcattttgcattttaaggagttgctccagtaagcttctattccttgttcagattttaaaaacttaaatttaactcctttaaaatagtatttttccaactaacgtggtagatggaagatacagaacaagtaattgagtcagtgcattttttttctgttttcaaaatattctgtatttggcttactacttttataattaaaatattaaaatgatattgttcttctgtgttataattcagttttatgcacaaaagccacaagtagtttaacagaatagtatcggtaagatcttgcctatatttgtcttttttagtgctggaatcggaagaactggggttcttattactatggaaacagccatgtgtctcattgaatgcaatcagccagtttatccactagatattgtaagaacaatgagagatcagcgagccatgatgatccaaacacctgtgagtactgtactttatatacaagtgtatattcttaacatgatgatttttgttgccaatgcatattctaaatcatatttttatccttttttatcttttcaattccttgccatggtcaaataacctctagcacaggggtaagcaaactactgcccactagtcaaatctggcctgccacttgtttttgtaaataaaattttagtggaacacagccatgctcatttatctatgcctgctttgatattatagctgcagagtttagaagttgcaacagtaccatatggactgctatttctaaaatatatttaatatctggccttttacagaaaaagttttgctaacatgcaagttgcctggcatattaaatcttgagtgcttaaacaggcacagaggaacttgctttgtattatttagtcaagctgaatgctgagaatgatagtatccctgaactggagagtcttgatagacctgctttctgtgaaatagctgtggtgaaattgtttttctttttacataaaaacttgcattgcagcggccgggcgcggtaggtagctcacgcctgtaatcccagcactttgggaggccgaggcgggcggatcacgaggtcaggagatcgagaccatcctggctaacacagtgaaaccccgtctctactaaaaatgcaaaaaaaatagccgggcatggtggtgggcacctgtagtcccagctactcaggaggctgaggcaggagaatggcgtgaacccgggaggcggagcttgcagtgagccgagattgcgccactgtactccagcctgggtgacagagtgcgactcagtctcaaaaaaaaagaacttacgttgcaacaacaaaaattacagaaattaagttactttttagtgcattctacactgagtattaattatgcttcaggagccaaaagaagaatcatggaattttagtgttaaaattatcttttgcactgattaagacactgtgaaataatagcattgttggtggaataggttacttgaaggaaattgacctatgtgatccagtaagtgcctataatttttttgtttttgttttgtgagacaagagtctcactctgttgcccaggctggtatgcaatggtgtgatcataactcactgcagcctcagcctcccaagcttaagcaatcctcccacctcagctgggactacaggcatgagccaccacattgggctaattttttttattttttgtagagaggggatctcactatgttgcttaggctggtcttgaactcctgggttcaagctgtcctgccacctcagcctcccaaagtgttgggattacaggcatgagtcaccatgctcagcttggtttttaattacagaaaatttcaaacatagacaatataatgaatatcatgtttatactcagatcccacatttgccatattgtttcatctggatagctgttcactttccctgtatttgaagcaaatcctagatatcatatcattttgttcatattttagtgtgtatctctaaaagataaggattgattttccttttaaataaaaccgcagtacaattatcaagaaatgtaatcaatttcttttttttttttttttttttttttgagacggagtctcgctttgtcgcccaggctggagtgcagtggcgcgatctcagctcactgcaagctccgcctcccgggatcacaccattctgctgcctcagcctcctgagtagctgggactacaggcacccgccaccatgccctgctaattttttgtatttttagtagagacggggtttcaccatgttagccaggatggtctagatctcctgacttggtgatccacccgccttggccttccaaagtgctgggattacaggcgtgagccaccacacccggccatcaatttgttaatattatcaaattggcagtatttaaatttctagttgtttactaaaaaccgtctttttaaattttataacagctttattaaaatacaattcacataccataaaattcagccgcttaaagtatacaattcagtgggttttgtgtattacagaggcttgcaactattgctactatataacttttatttttattttattttttatttttttgagacagagtttcgctcctgttgcccaggctggagtgcaatggcatgatctcagctcgccgcaacctccgccttccgggttcaagcgattctcctgcctcagcctcccgagtagctgggattacaggcacccgcaaccacgcccagctaatttttgtatttttagtagacacagggtctctccatgttgactaggctggtcttgaactcctgacctcaggtgatccacccgccttggcctctcaaagtgctgggattacaggcatgagccaccaggcccggctatataatttttaaaacatcttcattccctgccaccaccccaccccaaaaaaccccaagctcattaacaattattcccatttcccctcataccctctctaacctcccccaacccccaacctccaatctaggcaatcaccaatctactttctttctctgtagagttgcctattctggaccttttatatgaatgagatcatacactttggtcttttctaactggcttcttttaagtagcatatttaaaggtttatctgtactgcagtatgtattattactttattcctttttcttgttcaataatatttcattgtgtatatttttaccacattttgttcatccgttaatctgttgatggacatttatttggtttgtatccactttttggttattatgagtaatgctgccatgaatttttatgtgaacatacgttttcatttatcttgggtatacccaggagtggaattgccaggtcatgttttcattctgtttaaccttttgaggaacggccagttgtttccaaaatttctgtaccattttgcagttcctctagcagtgtatgtggcttttgttttcttcacatcatcatcaacacgtgttactgtctttttttattttagccatcctgctgggtatgaagtagtatctcactgtgaatttgttgtgcatttccctgataactaattgtattagtctgttttcacactgctacaaataaacacttgagactgggtaatttataaagaaaagaggcttaattgactcacagttccccaggctgtacaggaagcatggctgggaggcctcaggaaacttacaatcatggtggaaggcaaaggggaagcaagcaggtcttcacatggccggcgggagagagacagagaaagaagcaggaggtgctgcatactttcagacaactatgtcttgtagagaactctatcacgagaacagaaagggggaggtctgcccccattattcagtcacctcccacaaggcctctcctccaacactgggaattactatttgacatgagatttgggtgaggacacacagctataccatatcactaatgatgttaagcatctttacatgtgataattagctatttatttgtatatattttttggagaactgttcaaatcttttgcctgtttttgaatttggccgccattttattggcgagttgtaagtattttttttatgttttctggataaaagtttctgatcagatctgtggtttgcaaatatttgcttccattttctctttctgttttcttgattatagtagttgatgcacagaagttttgaatttggtgaagtctagtttatctgtttttcctttatcacttatgcttttggtatcatagatgagaaattattacctaacccataaatgagtctacaagttttatagttttagctcttgcatttagcattgatccattttgagctaattattgtgtgtggtttgaggtagggttccaacttaactcttttgcatgtggttacccacttgtcccagcaccatttgttaaaatgactgttctttcccattgaattgtctcagggctcttgtcaaaaatcagttgagcacaaatataagagtttatttctagacttccaattctattccattgatttgtatctctgttcctatgctagtactacactgtcatcattactgtagctttgttgtaaaatttaaaatcaggaaatgtaaatccgtaactctttttcattttccagcttgatttagctattctatgccccttgcattttcatatgaattttgaataagtttattctttctgaaaaaataaaaaaaaaaccagcaaccagaatgttcatagggattgggttgaatctctagatcaaattgggaagtattgtcataatagtgatatcacatcttgcaaagcatgaacacaggatggtctttctgtttatttaggtattctttaattttaattgtagttttcagcatgcaagtcttgcgtttatttaaatttattcctcagtattttagtatgttttggtgctattgtaaatggaattgtttcctttattaaccaatagttttgtgtgtgagagagtgaatttcttaggattttcttttgacaagatcatgtcatcatgtcatttgcaaatagatatgttacttctttccaatctagatgcctctttcctttttctttgtctttcttgtataagtatcctggatagaacctccagtacaatgttgaatagaagtgatgagaccagaacacttgtcttcttcctaatcttagagggacagtttttagattttcactaattatcatattagccatggattgtttataaatgccctttatcaagtagaagaagatccctttgttacttgttcattgagtgttttcatcctgaaagtgtgttcagttttgttaagtgcttttcctgcatctgagatatcatgtggtttttggtcttttattctattaaggtggtatatgacattgatttttagatgttaaattgaccttgcattcctgagataaatctcacttggacatagtatgtaatgctttttatatgttgcctgatttgatttgctagcattttcttgaggtcttatatctatattcttacataataggatttttaaaaagattttaattatggcaaaatacacataacataaaatttaccagctcaaccatttttaagtatacagtttagcagtgttaagtatacttacatttttttgcaaccaatttgcaatttcttgcaaaaccaaaactctatatccattaaaaaaaactccccattttctcctctcctgagcccttggtaaccaccattctactttctgttcctatgagtttgactactctagatactttacgtaagtaaattcatgtatttgtctttttctgactggcttatttcacttagattaatgacctcaagattcatccaagttgtagcgtaagtcagaatttccttcctttctaagggtgaacataccacattttctttattcatttatctatcagtggacagggttgcttttgccttttgcctattgtgaataatgctgctaagaatatgggtgtataaagatctctttgagaccttgctttcatttctttcaggtatatacctagaagaggaattcctggatcatagcacacatgggcttttggttttgtttttataatttgtttaaaatcagaattcagatatagtctacacattttgattggtttatatgtctcttaaatctcttttaattgaaagcttcctccttcatttcttgtttttttttttttttttttttttttttggtaatttacttgataaacgaatcaggttgtttgcaacatatttctgacggcgtgaattttgccaatttacatcctcaaggtggtgttctctgtgtttcctaaaagtggtacatgtatggcttgagcatcttaggtcatatattctttcttcaaacgcacataatgtctgattgtcttttttttgtgaagttagcacccttgagtaatcaatccctgcattcattaattcattggatttgcaaaataatgatattctaattctatcattctgtctttattagctggactacttctttaaagagaaacttcatatctactatttggttagcaagtggtatagcatgtgtaggaaaggcaagaaaaacatttgattctttccctttatctataagctttcaatataatgaatcatttactagcttcctccaagggtgatgacttaaatttatttgggtattattttgaaatcaaggatttaaacatagttgatgtgttttagcccattgtagtttttgttgttgttttgttttgttttgttttgttttgagatggagtttcgctcttgttgcccaggctggagtgcaatggcgcaatcttggctcactgcaacctccgcctcccaggttcaagcaattctcctgcctcggcctcccaagtagctgggattgcaggcgcccgccaccaggcctggctcattttgtttttagtagagatggggtttctccatgttggtcaggctgatcttgaacttctgacctcaggtgatccacccgcctcgacctcccaaagtgctgggattacaggagtgatccaccgtgcctagcctgtagttatttttcttagtgatatccagattgtcctatttttggccagtgggagcctgttcaccttggcttctgagtccttttgtcaagaccctggtaactttgatagctttgttgctatcagaaaatatatccaggcccagcttgtacatcttgtgcccctgatttagaatcagtagtttctccaagaagcccggttctttttattgagaaactattttaggcaccaacctctgagcactaaggacttttatttgcttgggttaatttttgtctctcaaaatgataaatggcacaaccagtaaaatacatttatcataggttaatgcttatgcttccaatacaaattcaggaccacagtgtttttacttagcctcttttacatctttaacaagaatactggttctttacaatattagcaatgaaagacttagaatatcacaaatactccacattacacaactgtttcagaataacaacactaccactataaacagtatggctaatgaaaagagttttcctttttttcacagctctttttgccctttgagtatattctcccacagtatgcagtcaaattactgaggtgtttgtttgtttgtttgtttatttgcagtatttttgagacagagtcttgctctgttgccaggctggtttgcagtagtgtgatcaccactcatcgcagcctcaacctccttggctcaaatgttcctcccatctccacctcccaagtatcttaggactacaggcacacaccacagcacccacccaatttttttttctttttttgtagacacagggtcttgctgtgttgcccatgctggtcttgaattcctggccacaagtgatgctcccaccttggcctacgagagtgctggtattacaggcatgagccaccatggccagccaaattactgttttaaagtcccttcagggatgggtgcggtggctcacgcctgtaatctcagcactttaggaggccattgcaggtggggatcacctgaggtcaggagttcaagaccagtctggccaacatggtgaaagcctgtctctgcgaaagtacaaaaattagccgggcatgatggcaggtgcctgtaatcccagctactccggaggctgaggcaggagactctcttgaacccgggaggaggaggttgcagtaagtcaagattgcgccattgaactctagcctgggtgacagagtgagactccgtctaaaaaaaaatgtcccttcaaatagctctcctctatatggttgtcatcaactagatacacacattgattagttttatgatattgccaatgcttagggattttaagatttttataattatatgctatatttacattattccaaagtataaatctaaaaaggaaggtatatttaatgaagtctagtctagtctctgtccctctcctgctcccatttccctccatccctttataagaaactatttttatttattttattttatttttatttatttatttattttttttttttttgagacggagtctcgttctgttgcccaggctggagcacagtggcgcgatctcggctcactgcaagctccgcctcccaggttcacgccattctcctgcctcagcctcctgagtagctgggactacaggcacccactaccacgcccggctaattttttttgtatttttagtagagacggggtttcaccgtgttagccaggatggtctcgatctcctgacctcgtgatccacccaccttggcctcccaaagtgctgggattacaggcgtgagccaccgcacccggccaagaaactatttttaaaataatttattcttccattgctttttttttcttaacatacatcaagatagatactgtattttcttccctttcttttataaaggtaatataatatattatacgtactttacctaccttgctttttttacttaataaaataacctggaatcattctctagtagtttgtagacttttatcccttttcttcccgactagctagtattccattttgagaatgtacagtagtcacctggtccctgttgatggcaattaaattgtttccaccttttctgttataaataattaggcaatgaatagccttgtttgtgaatatgtgttttcagtttctttttctggtttattttttggatagattcttagaagtgggattgctgggtgaagaggtaaattaggttaattttcttatatgctgccaaattcccctttatagaggctgcagtattttaacatccctaccagcaacatataagtgagttttgccaacaaaatatattgccaaactgtattttttaaccagtctagactgttagtgaaaaatggtatctttatgcagttttgttttgcattttttaagtaagcaagccaagtgagatgtttgtcttttttggggggagaggggacggttttctgacttttctgatcagttctgttttttatattttatttttcagagtcaatacagatttgtatgtgaagctattttgaaagtttatgaagaaggctttgttaaacccttaacaacatcaacaaataaataagaaagcaaaaagatctgggatatgtgttggaaaactgctttcccttatgttcactgtgccataatgctgctcgcaggaaatggcattttacaaaaaaaaaatgaagaactcaaaaaaactttgaaaacttcagcactgttgcactttatgttttaaaaaatgtcactctttcaaaatctataactcatgtatttgaagactgtttcatgctttgctccgaacaaatagtaaataactgagtatgttcagggtaatttatgaaattttgtggtggtgccatgcaatccccttttggtagaattgccacaaacaaggctcaaaattctcatcatctctgttatacacctgtatcatgaaagcaaaaagaagtaaacatcaggagtcagctctg

SEQ ID NO: 1596 - DNA, 116548 bp, Homo sapiens
ttccaattagccaccttatataatttattatgggagaattatgaaatacatatttagatccaaattgtctttaaaaatatgcattacaactggagttttccactgagaataagagtttggttttgacctcacataaatccaagggttcttgaaaaaaaagttaatataaattctcaataactatatcattaataccttatgtatacataggagtttatataatgcatttaagtaacaaagaatgtaacatttattagccaccaagtaattaggagatagcatcaattatattgaaagaagatgagtttagatgcttatagccaagggagttaattgaaattgaaagctattgtaggtggttactactattattatcaaacctgaaagttggaacatgtgaacttgatcctttgcacacataaaagttcacaaagctgcttttaatttgcctttgttctgtagtactgcttggtgaatcatgcactagtttgttgtaaaattcatgtaaacttttatgtatacaaatgtcagatcaagcacaggttttattaattatatatattttaaactgccaacagcaaaaaacaaaaacaaaaaaccccagaggccaataagtgaaatgcaataaaaaatgaaatttattcttttggctcaataatgacgtagctcaccattctttttagcaatagcaattccctgcatgcagttcttcaatacactacagtaaatagttttgtaaaaagaattaacattaaacttttggtttgtgcaaaaaacaaaaatttatatcatgttaggtaattgcacaactttgccactttgttcatggctaaaaagaacaaagtccatgttatatttgtaatagctttagtgcagcaggaattaaaaaaataagactagtctgcatacgtaaatactacaaaagttgaataaaaaaaaacatctatgaataaaaggttatattgaggcaaccatagttggtagaaaatgatctaggtttgagtgtttgaccaatgtatctcctattggaatggtagaaaatatattataacaaagaaatccataaaacccattatctaacttttattttaggaaattatccattgaaaaatcttatggattcaaaagtttggaattgtgattaaaaatcaaaagcaaaagcataaagtaaaataaattgtgatgtcatcaacctgaaaataattttcttatgtacaaaatgctgacaaataaagttgattatatttttacattatttatatttaaacaagttttagacatatttttagcaaaatatgaagaataggttttgtcagtaggcagtatccagtgtgtttccttgaaatctagagagataccatatgatactcatgttgaattaaaagtgcaaaagtaaaggtgtttgtaaatagcttcaaattattctgcttgacataatggacagagcaggttgaattcattctatcaccaatatgtgacattctttaaccaagacttgtgaagaatggattgagtaaaatagagcagcataggcaatattaacatgcattagtgatagcctttaaactatgtttaatgaatgatacaggatacatccctgttggaagcttgcaaaagacacatacactgtggtacatatttgatttaatagaagttgtttatcaggctatatatatatttgcccaaacatgcaccacaggataaaataactatttacataacatagggtatttaattgacatagactatcagctttgctgagagcagaagatggcaaagcaatactgcagcagaaagtggaacaactattctaaagcaatactttagatatatttttctagaatggatttattagattactttttggaaagcatttgacctaaattaaatatagagctctgaaacttagaataaaatttgcacttgctgaaacagaatactttgcataaaaataatcctttaaatattagaggagactttacaggcacataactgttcagatagaaacaaacataacagactaaaatactttcaaaattaaagccatctagaaaatggaagtaactgaaactgtagccattacaattctttttctggttttgagcaaaaattttatctctctggcaaaacacctttgtctgatcatttgagagacagggttcttgtatactgtttcttcaacgtaaacctcatttacaaaaatagtgacatagcattatgaataaactatgaattggggaccatggaaatgcactagaacaaattttgtaaaaatatggcagatatggaagttaaaaatagaatggatgcaaggactgtactaaaggtgtttggtgtagttacaatgttcactttgcacaactatccctatagtctaggtagccattgggtttctcctcagcagtgtcagctggtaataaaaacagcaacctcttgtcaatgttgataccctgcttcacagagttgcagtgacagagaggtcacttcactgtcttgtataggcactgactatgagtatttgttaaaacagtcagtttggcatggacctcctcttgaagtccagttgacacatatactttaccttcataggctgtaaacaattgatcacaaagataattctttgtttctttttacttttgattttctctgacctcttttcctttgctttctttttctggtttgtctttctcaaacttttccttgtctggttttgttacactatcataggaaggaggagaggtggtagaggaactcccatctgttttttctggagtggagttcccatttagtttgtcaataatcatgtcttgttttataggtaagtcaatcctccctttaattgcctctttgttatagttacttgatatattttttaacctttgctttaaaagataacatctgaaattacgctgaatgatagcggcagacacctcctcttgtttacgtttcaaagtggttgtaataggctcataagagactttggaggggtttgatgccataaacctgtcttccatctgtattcgaagggcatccatctctccactctcacccaaaacacgctttgtaaaggcaaataaaatatcaagacagtggatccggtcaccactgaccatgggcagatccatggcaataagctggactttgttgggttttgctatgagaagaggaggatccagggcagctgcaaaatcagagagtttagagaactctataaactgggtcgcatcgggatcaaacttttcccaaacctcatagaacatctcaaagtcatcctcactcaggggctctgcactttcttcagtagcaacactgaagttctccaggatgaccgcgatgtacatgttcaccacaaccaggaaggatatgatgatgtaactgacaaaaaagaaaatcccaacagatgggttcccacagtctcccttaactgagctgccagggtgaattgtgtcagggtcacagtcgggtggtgcactattaagaataggtgctagcaatccatcccagccagcagaggttgtaatttggaacaagcagatcatgctgttgccaaaggtctcaaagttgaacatgtcatcaattccagcttcctttttaacataggcaaagttggacatcccaaagatggcatagataaacatgaccaggaagagcaggaggccgatgttaaacaacgcaggaagggacatcatcaaagcaaagagcagcgtgcggatcccctttgctcctttgatcagacgtaggattcggccaatcctggcaagacggatcactcggaacaaggtaggggacacaaaatacttttctatcatctcagccagaaacatacctatggaaaacatagaacacagctaaacagataatatctttcacttacatgatggctttatcttttttaaggtctatgaacacaacaaacttgttatgaatatgagcctttattaaatatttggatccactccctgacattagcaattacagattacagagttttattcagtgattctgtaatgtcataaaccaatatgaatttttgcaaaatccaaataatctccaatggtagcatggcaatttaagattatatagacccaatttatatgaattgttatccctacacatgaattgtggcaattacaaacaaaaatatttctgaaatctctgaatatattgttttctattttttaatgatactcttcagttagagagaaatgggccatatttgacatgaggttaaagttgaagtttctaaatttggggttctataattccccatctctctttttctcctactaaatctcaactcttctttgaagacccacctaggatgcatcacctttatctctggaagcctgtgttaactcattccagcagagatggctacttcctcttcagtgcttcttacaataccaactttattgcattacaatgatttgttttttaagccatctgcctcttttagcctgtgaccttggtttaagattaggagagtacctgataatgtttatttcctgtcttcttcacctctttcccaaatctggtattcctaacatggtttctaactagttagctttgtgaataaacccaggtttcagagtttttattcaaatatgctagtgttgaactttacatctatatgcattattattctcagacctaatttccatgttaatcagctagaaggtcctggggcaactgtttctctgtaactatacctcttggtaattaagctgttcttacctacaatggagagaatcaccaccacaaagtcaaagatgttccagcctatagtgaagtagtagtgtctgagggagacgagcttcagcacaaattctccagtgaacagaacaatgaacactaggttgatccgggacaaaactagggtcatgtatttgccctggtcatccgtttccaccatcatggtgaccatgttgaggcagatgaggatcatgatgctgatatcaaagacttgtctggttacaaaatcaaagaccattccttggaatttgttctagaaagtgagagaagagaaataaggttactatatatatttcataaagaataatgcagtaaaattgtagataaagcccttccacatacgggatggatgtgcaccctcctcatattaccccaaacaattttgtgtgctttttttctcttcatgttaaaaaaaatggaaaaaaaatttatatagctaaacaaagcatatttggtttatataggtcctatggaaagacaaagctggatgagacataaattaaggctgggcgtggcaactcatgcctgtaattccagcactttaggaggctgagactggaggctctcttgaggccaagagttccagaccagcctgggcaacatagtgagacctcatttctattaaaaaaaaattagcctggtatggtggcacaggcttgcagtcccagctacgagggaggctgaggtgaatcacttgaccccaggtgtttgaacttgcagtgagctatggtcttgccactgtactccagcctgagagacagagtgagaccctgtctcttaaaaaacaaaacaaaaacaaacacataaatttgtgacaattggctgataatatatgtagtctttgcttgatttgaataagtatgataatttttataaaaaatagtgactactaataacaaagatttacaaagcaggttaatatcaacagatatttagatagagaatacaccaattcatttatcaatattttagaaattttggtttataccttatttccctcccctgaaatacatcagtcatatttctattgaattctacctctctagctctgtgaatctatgtatgggcttgttaatttatctgtatttctttccatctgtccttctttacctatgccctgtgctttaacaaaaatgcatgactttaaacactttttttctttgtcttattaacaatcatctcaggaacaacatgctttcaaagattcttatattaatatggctagtaaatacagttttattaaagaaatatattattaatcatttagagtaaaaacttaaaacttcatggcttaccaaaaatcaaaggtcatgaagtgaccatgttttaatttttaaagaactctagtaaagtcagttcaatcctttcccctcttaccctgctccctcacattccagctccaactactcttataaatatggtaaagtcaagtcacttagagaatttatggggccttgtcaagtcccagttctggcaattacaagatttgtgacttggggcatgattcgtatgttctttgggcctcagtttccttactccttaccaatctcagaaaatagctgagttagagtccagctctgtgaacataatctgtcattattacatcattccatcatcatgaggctctacagagtatgcattctgaatatgccttattctgttttggtgtatttggtgaaacaaacaattttgatgacaccttttccctttctaaacaggtttggaatattttctagtcttaagaatggagggagcagagagtatagagggaggccttggagagtgggatgggaaggctagaggaggaggaaccaggtgtgctgttggtagcaggaaagtgaaccttgctttggaagtatttattaggaaccctgagctagaagttttcaactcacaaattataaagaacattacctcctttttttggaatgtggtaactcctaatgagtgcagaagttgtgaattatgatgcaaaatatgaactttataattagggctcaatattggtgatatcacctaatatgttctgctccagagcattgctcaatttgaccatatggacgcatggctttggaacattaaaggagacaagtaattcttactgctgggcgaggtatgggtttctgaggtttcttggatccaagtttcttcattgcattgtaatattttttctgttcctctgtcataaagatgtcttgacctccaaagtaaagacatagtataaaactggttacaattctgtgttccaatagtactttcacaaaaaatatttgtctttcctttaatcttttctaatttttaagtggatattatcctcctacatatacatttatcctgcttttcccatttatgtgaaattctgaatatcttaatattatgcaaaatccttacgtacataaaactctgatcgctacaggatcctaatttgattatactatgtttaaaagtaggcacaagggtctcaaatatatttttgcaaaacagaaaacattttcttagtccatttcactgccgataattttacttcttcattcaacagtttttaacactttctgtgtgctagacaatgtgctgggtgtcagaattacataaatatataagatacagtattctgcttctaaatggagcaggaaactgaaaacgtaggtggacagtgtatgttgatatgacaaaaaaattaaatgtactgcagaggcaacaatgaattcagagactcagagacaagctgttacatagcttacccttaagctaggccttaaaagatgattatgggttttctaggaacattccaggataaaaaaaaatcacaaaaagccatggaggtacaagagaatgcttgttcagaaaagggcagaaagctcatatagatgtatgggtggtgactatgtagtagggaaatacacatgtatagagtgaagtgtaggaaaaaatgaagatggaaaactgggtggaggtaattcctgaaaggctctgtaagccaagctaaagcactggagacccgttggatgggtccgaaggagtggacacatttttgggtcagaaagctatccaatagataaactttgagaggagccactgactagaggctggaatccctgcagcttaaataaccacatgggcaactgaaaataatataaacatgatttaagtctgtcatgaccacaggtattctggttatttggctgtattaacagacagaaccccagaatgaagaaaggtaaaagctaaagaatacttatcttctttttctgctggttgaagttatctatgatgacaccaatgaatagattcagagtgaagaatgacccaaagatgataaagatgacaaagtataaatacatgtacagattttcttcatatacaggctgaagtttaacctaaatgatattgaaaatattaaataatatgaaaaatactataaatacttacactaaatcagtaatttattgagtgctgttacttaatacagtgctacttttgccttaccctgagatattgttctacaaaaacaattttttaaaactagtatgatctagtaaaatgaaggtttgcaagttttatgattgttcttgattctcttttcccattgtgccttacatttaacatattctttaacataaatacggtgatataagcagggaaaacattttgagcctattattagtcataattttttgcagtattttctgtttggttttggaaatgctgaattttggaaatacggctttaagagcagaacatcaacttctaagaggaaaattcagcacagatatattctgtggagttatttttatttttattttctaaattgagtgtccctgaaacttgcttgcttttctgtatcatgatattcttggaagctgcttcacagagtctggtttatcatactctccagggatagggagagacaagttacttccccactgaacaacttttccactcagaatagtctcatttactggaccaatctaatgtcttaggatccatgcagctagatatcgtttcatattagctacatattgtatattaggcacacattaatcaagcatcatctatattgaagcagactgttcattttttatatgcaatattaaatgttctaatatagaattttggatgtatcagtgtttaaattaccaccaatattcaccataagaaatctagaacctataaataatatttgagtgatacttacatctcgtgaatcaacagctgcatacataatatccatccagcctttaaatgtggcctgtaaataacatatatttgaattgttcataaaaatttcacctaacaatgacatttaaccagatgaaaatctgacagtattataacaaataactttttgtacaatattgtgaaatttcatatcaagagattgaaataaaattgaaatagaaaaacatttgtatttaaagtctggaacttgtttccttttttttcttgaaagtattctattttcttcctacactaaaatttagtgaaagactttattcatgaaactgccatctcagtcccaattcccttatatgttaaagtgtaagctctatgatttgcattttgacacatagtagaatcatatttcttagacattgttataataaattatctggctaataatttatacatttaattcatcactacaaatatgcattgttattttagtacctaaagttgctcctttggcaataattgatacagaaaactaaaaatgataccagtacccaaaaatataacaaaaaagaaagcagaaatataaaatcacattaaaacatactaaaagcttaacactaaggaaaatacattataaaataattgtaacatcttttttatgatcaattcaagctgatattataggtgttatcattaactttttttcatgctgtcaaatgttagtcattcaaacgaagaacatcagggaaataatcttccttgaaacatcttgaaaactttttcaaaactcgtacagtagccacttaccacttgaagcagtgcaagatagccagcgccaacattatcaaagtttactttcacgtttttccaccgagcttgcttgccaagagcctgacagtcactcaaattgttaacatcactaatgtcaaacatgttacccgttgtcatgttaacacagtggtagaacttgccagcaaacaaattcacacccatgatgctaaagatcaaccagaagatgagacagaccaacagcacattcatgatagagggaattgctccaacaagagcattcacaaccacctagaagagacagcgaggggaacatagcttacaaaccttttgaatggaaaccattccttcaatgtatttgtttagtattaatatgtgcttgaaaagagttaaataaaaatctaggtggacaagttgtttcttctaatttttctagcacatatttgaaggaaaacaaacaatgacacaactaaagagctaaggttttaaggaaagcaaaatatgctacagtatgaaaagaaatcattaaaaacctggtatagtaagatggagtcagaaaatgtttgtatgctggggaaaaaagaatagaaagatgcattaaatgccaacagaaaaaataatcatctttcagtaatacattttaattttcaagagtgttaatgaatgaatgataatttgaaaaagccagtaaacaaaccctttgcaaataaacaaagtattaaaaatgccttaaatctatattctcagatcaagttaactttttatgactacgaagaacaggattaggaatttactgggtccctttttccccctgttagtaaatctcaataaaaaggtttattaagttaggggaaaaagtggaatttatatctggtcgtaacagtactggataagttcccattattattacttcacaatctcttaaatgttcactttggagcacatgctacttcatcaacccaggctgacctatttcatgagaggaaaattcattcacttctcattaaattcagaagatattaagatgtattttgaaatctttatgaaagtcaacagtaatttttcttgtctaatctagttcatattggaccattctgttaatcatttatgttaaataaaagtattgttttattttaaaatactgcaaacattattttagaaatcaataccaaggaatcttaaattgacatcaaaaccagaaatccaaaattgtaaacatttcctatgctacttgaattttgtttcttttggaagttaagccatatgcattatacttgccagggagagaatgcattcactgggttcttagtttctgtttctggctgggcccgtaaagtcccttcctcatccctcttttccacttatcactagagatagaaactaaaaaccatggcttcaggctgttagtagcctaaaacaatatagaacaacaacaataacaaaataaggcgggttggacaagtttggtacacaccaccacaggttctcctgttttcaagtaaatgcataatacattatcataatttgcatctggaatattaattgtgctatatgactgaattaaaaattctaaactttgaatatttttcagattagagaaaatttataagttttaaattttgctcagttgctatctcccctcataaatgaactgttaataggaaacatggaaccaaatgagagcttaagtattatgagtaatggtaaaagtttggtttgaaaagaacttgaaattgtatagtaatttttatgaattttatcttgtctaactttctttagcattagcaaggaaatgaaattacaatgtaaaaaccaaatatttctttgattacaatgattctggagagtctggagagtggcttaattctccctgatgggtgaactttaaagtcaaggttgaaatatttttattgccccaaaccaaccatctcctaacatcctaacatgaaagccctatcacctagactaaattaaatatccacatgcactcacaagccagattaaacaaaactggcctttgtgctgaattctaccgaggggcatggcaaatgggtggtatctataataaagtgtgattttatgtttagatgcataatatacatattaaggaagagagctggggaggaaaatacaactgctatagaaaaagtgaaccttattcagaatgctcaattagaaaaaaagatctataaaacaaactctgggctgggcgcagtggttcatgcccgtaatcccagcactttgggaggccgaggcgggcggatcatgaggtcaggggatcgagaccatcctggctaacacagtgaaaccccgtctctactaaaaatacaaaaaattagcgggcgtggtggcgggcacctgtagtcccagctactcaggaggctgaggcaggagaatggcgtgaacccgggaggcggaagttgcagtgagctgagatcgcaccactgcactccagcctgggcgacagagcgagactccgtctaaaaacaaacaaacaaacaaaaaaaccaaaaaactctggaggttgcctgaaatgcttaattaccttaacccttcactttggatgttatttagcaatttgttagaggctaaaattcaatgttgtttccttatgcaataatttttattactgatattaattcaagaagcaaagcacacaaaacccattttacctttcattcattgccagtaattttgaaggaatcaaactattgagagaaagaaactccccaccacggatgaatgtcagtagtcagtagtcatttcaaggggtgtaagcaatgaaaagaaacaactggcagtccaaggtttttgagtgttgtagaaacatatttgaactgtgacaagaagacctggatgctagtctcagttctgtcctcccaaaattctgagagcctgtttaaataaactccagtttcagaaggctaggctttgtgatatctaagatttttgctctaattctgtaattctatgaaataaatatcagaagagtatggcacccttttctatctaaatcattacctacatgtaattttgacatgaataattagagtgtctattcttcttaccctcatgccttcaaaccgggataaggctcttagaggtcttaaagctcttaatgtccgtaatgatttgatggcaccgagttctgagtagccaagagcattggctaccaggctaaccaaagaaacctacaaaaggaaaaaaaaattaattagttcaccaagaaataaactgttgactgaaggtatagggtgtggtatctatttaatgcagactaaatactaatttggacataccttggcaactttcatcttccacatagtggggtcatcttatattgccagtctcatctcatactattgcttttttttaaccaatgaaaccagaatacttgcccatatttatcaacacgtgtcaatatctccagttagatattttataccatggaccccttttcaacttgtgcatataccactgataattcaggattgagttcaatgccagatccttcatggatgtgtgcttaaaattattgattagaaataatgtttctctcttgagtttatgtaatatcttagttatgcattctggaagcattcaccatgtaatagcgttcactgattagatatcttatctccctttccagatcgtatacgtttttttatcagctgggatgaaacattgttctcttaacatgtctaacgctgtctggtcagatatactttagccaaaatatgttggataaataattattccagggaaaatttttatccaaactgctggacttaagatttagaatatagtcctcgtcattcagagagatggtacagcttcctgatacaggctgagcatccctaatctaaaaatctgaaatctaaaacgctttgaatgctaacatgacactcaaaagaaatgcccattggagcattttggattttggatttttcgattagagatgctcaactgacatagaacgaatattccaaaatccaaaacacttctggtttttgataagacttaacttgtatttatactaaattttacttaaatatatgaaagatcaaagaagacatgtccttttttgggggaggaagtttatttgctttaattttctttcaatataataacatgtcttcatgtataaatccaaagatatagctaccattaccatcacctctttatgtgtgaggaagttagagcgccacccccacccacaacaacaaaaggatgcacagctaataagagtagaattggcgatttgaacccaaataatctgacgtcaaaagcatatcttaaccttttgcatccattaaaaatgtttcttcttcatctgaatcatagggcactgaaaatgatttgaatgaccatcttctcagttctttcaaagatggtacataactagtgctttccttaattcataagagagaaattaattcattatatccacaatggcttaagagcattagggcttaatttcctatgaaaaaaggctgttgaaaatggatttaagtgaatcctcccaacaatcttgtgaaatatgatgaaatcaataatgtgcccaagaacacaggatataaagagtgataccaaaaccagaacctaggctttaacaacatatgaagccactgtcctctcattgtttaatttagcatacattttaagaattgaacagaataatacatgacttgactgctaaacttgattagtggcaggataattgattgagctattcatttctgtcttaggtttgctgttatagaagactggaaagattggaaaggttattagagaacacacaggcttctatgttctatgctccttttcctcaggaggaattaacagcttctttatgtttctagagttactatctgaagatttttctcaacctcccaacaaaatcctttatttgagacatgggattttaaagggacgtggctgcaaatttctcaagaccttgaagtaaggaagcttatgctttgaaaagaaaagtaaaactgggtgtgatggcctatgcctgtaataccagtgctttgggaggctgaggtgggaggatcacttaaggccatgagttcaagaccagcctgcgcaatagagtgagaccttatctcaacaaaaaaatttaaaaaatgattagccagggatggtggctcgcacttgtagccttagctatttgggaggcttaggcaggatgattgcttaagcccaggagttccaggttacagtggctatgatcacaccattgcactccagcctgggctatagagtgagagcctcttttctctttaaaaaaaaaaagaaaatagtaaggtaatatccagaacagtgggttcaggaaagataggaagtcatgagtttaaaggttgaaaggcaccacctgcatctaaccaccctacatggcatggaattgtgtgttgttagagaagctgggcttaatgaagctacacttattttaatggacctcatggcccagaggacatagtgccagagttgcagccacaatatgtgaggatcagaggaaattagcaccacatttctaggctacatatgtcctagaatttctagaagttcccaaggagagatcataaaaaactacctgacactggattttctgacaaatctgtgctgggatctgttgcgtatttgacttatataggaaaataaagggaatttaaaatatttttaggactttgagaatactcactgcagattggtttaatcaaataacttaaaatgatttttccacgcaaattacgataagattatcacaatctgatcaatcacatacataaatatttttttctggtttgcatgacttaagctacaatgtcattttgtataaggcaaaaccttattttagtggtttaactgatgtgaaaaaatatggtttaaaagctattttgaaatgagatctttcaaatctctattataagtggagatagctccttgcaagaattttaaagatttgcaacatacataaagtttgaagataatgactacattggtagggtgctttacaattcacagtgacctctttcactcattatctttgtgtctcagaatagtgaaatgaccactccaaggaaagatggccacaggtaaacatataactagaatttaggtcatctgtttttatgtctaatgtgtttttcaccttagcaaatttgtccccaacctttcaatacatagtgttttaatattatctcttttgtgctaaacacaaaaggcactcttgccaatgtgtgcaaagtatgagatacccatttccaaaaactaaatttttaatatgaatttatatgaccctaggtaccatatcacactacacagtaaataaatggaaatgtctgtgatagaggtgtcaggggttggttcagttgtcatccacacctttccacattcttatggcagctgagactgagaaagaaaagaataatgcaggatggagttgatggttccaaagaagattctggaaatcctgtgattggttaaggaaccaaacaacaggaattttttttccttgaaaatggctaaagacaatgtttaaagttcaacatgaacaaataaaagataaaaactctatatcacctccatacattctgatgatatatttcaatctaaaagcttgtataatttttgatgatgagatccataagcattctcattaaaatcagaataaaagagtatgcccatcaacaacattattatttaacactttctggaaaaagaagagttataagaattagagaagtgggagaaatcattgtttgcagatatattgttgttatcttaaaaaatcccataagagaatcaagtgaaaaactattataaacaataatctaattattttaggcggttgataaatacatttttcatcttaacttttaaaaaagtttgtgtaggagtctttttgaattacaaaaactttaaaaatataattcagaaaaagtaaaagtataataataatttaaaattttgtgaagaagaaaagcagagaggacaaatttcaccagatattgattataaatatacagtaattaaagctgttatattagcagacaaagaatgaatgaaataaaataaagctcaaattagcatgtggatactgagatttagcacatggataaggagataattttaaatgagaggagaaatagaacaactgattattcattaaatgagaagccagatagaaaaaaataatactagagccttacctcacaccttacaccaaattaaatttcaggttggtcaaaaattgaaacataaaatataaactaatggacaaagaaacaaacaaaattctccaactaaaaaactgaaaaaaaaaagcccggaatatttttaatagtcttgaaatgggtcttcataaacatgagaaaaccaagaagaaaaaaaattctgataaatttgactaaatcaatatgaaaaatttatacatgacaaaagaattcaagagacaaaagctcaaattagaaaaatattcataccacatgtgacaaaatactaaatttccttaatataaaaagagctcctacaactcatccagtaaaagctcattaaccaaatagtaaaacacacagattctttctaaacttttactatatctgtttgaacaacatatttatttataccccctactgaagttcaactagaagaaaagcaaaggaatacagacaaagataataggagaagatacaacaagaagagttttaaaacattctggactgtggaaagcacaggaataattactttctcatcagagaaagagcagcagaaacccaggtgcctgcaaaagcaactcaaattgtttcaaaaaatgatcagaaggctctggaactggaggcatttggttgctcaaaaacagaggggcaattgatggagctgaaaacagaactgattaaaattttgtatacaggaaagctagacactcttgagtcccttcacccaacgctctccaacccttcagagagcagaataaaatacaacttcacaacttctggagtaaaatctgtacttgctacagacatcagaacatctaaacagttatctacattgttgttgggtttccctgcaacaccacagatgtctcttccagtatatcctgaagttgagtttttcccattaatagtactgaggggcttaaatagcacatggtatttaagctcagtatttcttaggacaagggcacccggaatttcagattgctagctgcacaccttcctgcttccaccacagaggagccctatttcctatctgctgagtagttcctagaaaagggctcaggtagtggtgaggggcaggtacaaagctgccatgggaatggtagcagagagctctagtgaagatgggaggttggggatatttgtgacagagggatttggccagctggggtgggtaaggtgtacagcaggaatagagcgcaggcttccagaggctgtgggaagtgcagtctctatgcaatctcagtcagaaatggaagtccagactgggagtggtggctcatgcatgtaatcccagcactttgggagactgaagcaggagggttgcttgagcctaggagtttgaggttacagcgagctatgattgcaccactgcactccatcctgggtgacagagagagactttgtctcctaaagaaaaaaaaaggataatttatttttatgtaaggggagtttgtaagtttgtaactcaagggccgcctctttgctttctcttctacttttatctttatggtttatttattggtctttaactttatacatgattagaaaattcacaatgctcacatgctatataaaagcaaataccgtggtcattgtggtattgtttataatagcaggaagcagacgatctaagcgttcatccctgggaaaaggatgagtaaaatctggtgcactcatcactggtgactacaatatggtacagagaagccatgagtttcacaggaatttcacttaaacattccaaacactatgtgcagtgggggaggggtctttaaaatgaagactttgaatcaggtgatctctctaagtttatttctttgtctggaattcttaatttggcaatttaaagatgattaaatcaaaataacactatatgttctttatgttgaaaaagaacaaatcaaagtatctttgttaatagatgcatcatcttcaagcacactcctagaaaaaattttaaagtgcaattttgattcattgtgagcataattacttctgtttatgaagtgtgtaattatgactgtatcttcaggtgtaattatttctttttggaaagatatgaattgtttttgacattttacataatgaatgtatgttatatgttacttaactagataactactctgtgcctcaattttcccatctacacactaggaaagtaacagtagatgctgcataagttgttgtgaagattaaacaaattaagcattgaagacaaaggacaatttatagctcagttaaggttggttgttattagtattacaaatgataacgcttgtttgcctttactgtcaccatttagaatgctggctgatgaattgcatcccacggggaggcctttaagaagaaaaagagtgatgtaggtcttccgaaaacatttatttgcagaggttgtgactggaggcaggaacatttagtaagctattgcttggtccagttgattgcagtggtgttgatgtgctgaagaggaggggcgagactgtccactcatttattagtcaataaaatggagaagaacttgctgattgattggttgtgaggggtgaaaggcagaaaggctgaagatgacatctggcctggatttatacaaacattaccatcagactaagtagggaatttggaagaaatgcatgacttagaggggaaacatgatgaacatgtgcagataacaggtgtattaacatgtattatctaggaagcagttagaagtatgggttggagtttaacaaaagaccagaattagagattaaaagtctctattaaaagccatactctttcaaagaatgggctatagaaatttatagctacattagtaggattatctttttaaaccttgcctgtgagaaatttttcttattaattaattaataatgctaaaggagaattaaattcttccaagaaatggacaaaatgaatcatttctatcagaagacatttatagaaaaagtcaaatcacatactagactgtttacacggaaatatatctagagagagagatcagaaattaatatgaaatgacaataatttataattatttagttcctttaccccaaagctcttttaatttattctaattctctgcacaagggtgctagataaaattcaaggcaggtgtctgcatattagcaaggcaccatctcattgctttcattcaccaccacttatacgcaatcaccttcggtgtcatgtgggaactctttgactagttcagcacaatatgccaaatagatctgtgccctattgtaaaatatggatcaaagaacccagtgttgggtaaaggtagctctaccacctactagctgtatgacatttctaaacctgtgaaatagagataacatctgtagcaaaatagaaataataatacaaaaaatcaaaagcttgttaaaaagattaataaatactttgtaagtaaaagagacatttataatgaggtttgtaatgtaggggttagaaacacagtcattagagccagacaacttgggtaccaaatccagcttggccacttattagttccgttaacatgggaaagtaacttaacctctctttgtcttagcttccctacctgcaaattgagaatagttgtttctaactcatagaattttgaagattagatgagttaacacatgtgaagtgcttttggtggcacctgtacacagtgtgcattaaatcagggtagtaattttcactattattatgtaaggctcttaattagtgccattcccacaataagtgcttacaaagtactaggcataatatctttctactactattactactaataacaatctagctccattattgaggttgccaatatgtcaataataaatgtcaagaactaaggcaggaaatactagatcctaggggttgctggcaaatggaaatacatattaggatcagaaagtgtccctatggtggttttgttcacctcaacagagcagcttatgggattctaaggagcatgtgattaagcaggaaaagcattccaaagccataatatcaagcatctccttttaacctgtgctgttagtgaaaattacctgtgagcaataaatacttcatgatggttgaatcttttactagagtttgtttttcacacattagcatgttaggatgttttagaatcaaacgaagtttttatgagagatgctcagatgcattttctcagagatgactgcaaaaattgataaggacctcaagaaatctgatgttttcaatacgttttaaataaatattaattaaattatgtatttacttcattgtgtggtcaatagcagcatctatagtatagtttgtgtagttataggatggtatagtaaggtatattttgttttttaaaatgaacatagtatctttttgaccttcacctgagaagaaaagaattgtacagaatctgaaaaagtgctccttctagtgcagtattctggaaggcagaggcatgagttaagttgcccttgattccatcctgaagtatcatacttgctgtctccatttcttcatcttcattattttctgtcatccacaacaccaatgaccttcattttgccaaatccaaatgtcaattttatataccaatattgcttgatttttgactttttttcactgtagcctttgataaaattgatcacctctcctttggaaaaacccaactatcttctctgggtttctatgacaccatgcatattttgttttccttttaattactacttctcagtctaatttactggctggttctcctttgcccaacttctaaatgttatagtgtccccagagtttggttctgggttgccttgtttatttgcagtctctgcctaggtgagctaaaacaggtttgtagcttcaaatgccatatacatctcgatgaaccttaaatttatatacataagattctggattctctcctgagctctagatctatataaagttcagtaccttgttttgaatgtctaataaacatctcaaatgaatatatatcaaatgaatacatctctctcccacccatcatctacctaccctgccaaatctttttctgatattccccatcccagttaatggttctatcctctacccatttgttcacggtgaaagaaaatccatttgttgaatcctctcttttcttcactccacatatcaagcctatcagtaagtctcatcaccttggtctaaaatctccactttcttgcattattaaaacaacctcctaattgatctttctgcttttactctttgcctccccctctccatagccagatatgatcattttgtaacagtaggtcagatccctgcttatcctgctgctggggcttctcatggtcattataactaatatatgatagattacataatgttaacatatatgatgtatagtaaattacaataaaatacgaacttcttgccatggccactgtgtactttttgagttcggtttctaccactctcactcatgtttcatcacatacaagtacgccagtttctttctatctcttttatctccttggctcattcccacttcaagcgcttctgcttcttctcctctcttctcccaggtcttcaaatgactggcaccctcccccatgcactcccttagacaccctcctggacactagctgacacactgctcctgccctccctccgcttccccaaacacgcagtaatttaccagcctagtactctgttttatttcatagcagtgatctgcctttatcttatctttagattttacttgtttacacgtttcctgtctgttcctctcctccaatagagtgtaagcttaacaaggctaggtctgttttgttcatttctcctttgtcttgaatggcatatgatcctttataaggtactcaaaaatatttattgaataaatgaatgaattttaggaaattacaaagatatgtcactataaatctaattttacttttagacagagaattgaagaggttacattttttacacagacctatttctcaagtatgtgaatgtagttttcgaaagatacatttgaaaggaagtttatttggtgttctgtttattttcttgcttcattgattgcttcctttctttacctttctgtgactttaattttgttacagtgatataccctatgaactttaaactctttaagtccattttatttgtactttcaaacactgttttaaccttatatttactttagcttagtgaatccccagtactctgaggacaagctgttatctgaggttgcattaattcatgtatttaacccctgctttgggaaaattaagaaaatagacccatttaagatacagtaacttgcccaaaggaggaggctttcagtacccagttccaatctgctaattttgactcactaaaagcaaagtaattttggggcaccattcgtttgtcattcattgaaacattactcaatagatgtctaaatgtctgtgttaggtgtacaaggataaaaacatgatggaaaacctccaacctcaagagatttttacatgataatcatgttttctatataaggggagtacatagaaatactcgaagtacaatgcagtagttcagtaactgtaagtcagaattttctagaaaacttctatcacattttaaaataaccttgctgggcacggtggctcatgcctgtaatcccagcactttgggaggccaaggtgggtggatcacctgaggtcaggagtttgagaccagcctggccaacatggcaaaaccctgtctctactaaaaatacaaaaaattagccaggcatggtgcgggcacctgtaatcccagctactcgagaggctgaggcaggagaatcacttgaaccccagagacggaggttgcagtgagccaagatcgcaccattgcactccagcctaggcaagaagagcgaaactccgtctcaaaaataaaaaaagatcataatcttcatacatgataaaaatctttttgaaccagaaaggatcattgaatgtatttagtgttccatctttgacagagaaggtggagattttaaatgctaaatctcaaagccagtctgatgccagtctgatacacacacacacacacacacacacacacacacacacacacacacacatttacctattacaactaatatatttataatggatcagttaggcagaaaatctatgagggaaaggagcactgaattgagaattagtaaatttggacacgtatcaactttattattaagaagctgtgttatctccaaaaaatatttaaactgaggctttagttttctcatgtcttgaataaaccctagatattccttaaggtccactctagctgcggaatgtgaaaatactaagtttccatttgtgcatagcttttcagagttatgttgaaattcatctctattattaatgaaaggccagccaaggaaattgaaagtcatttctggtctattaaaagtgacttgacagcagatttcttatcaacttaaagggttaaacacattttggttatataattgtgaatatgtgtttgtgggaggaagaagagtagaatctggatagacccagactcgtcaaaaatgagaaaaagaacgaggcacacatatggcaatcattgattcatattgacaagtgttagagctaaaaataaggagctttgtgattgctaggaaatggctagagatagtatttgaagcaccttgttttgttaggaggctgtgaagccttgtgcaacggaatatcacagactacaaggaatcagaggactgtcatgttgtcccagtgcctctccgtcacttgcaataaaaaaacaggctgcacgtcagatagattccataattggcaatgttcctatgactactcaccccagggtaatcagattcagaacagacctacacctaactctttgcatggtaaatacctgattagctattgggatctaactactgatttaaaaatggaaatgcattttgttgtgtctgtgggtatgtggctgtggctgaatgaagtcagtacatgggttaatttcacagtatttagtcacacgtactctaggaagggattaaagtgcagtttacacactttctgaccttcagtcattttttattttgcttcttggagatgtttgtttgtttttttaaactgaactgttaataagctaagtgcttacatctgtcaattaacatattacttatctattacttaccttgaggcacttaactttcagaaaaataaaagctgtctatctatggtaaagaacaattctccctgtgtttgctcttaccactgcccatgtttttaggacctcctctactctttcccatgagatattcctcattgttgcatatgttacagttttgtttaaataactgcataattatgtcattattagtgaaagttttaataacagaaacatatgaaatgtcaaacttgcctcttttaaaaacaattttataaaaatcacttaaaatacttacatcaacgatcaagaaatctagccagcaccaggcattagtgaaatatgtttgaaatccataagcaacccatttgagaagcatttccagaatgaatatataggtaaagactttgtcagcatattctagcatggttttgatagtctttcgctgttcaatgtatatatcttcaaaggcctatgaatcaaaaatattttattttacttaaatggcttgcttcttctaaatatttgaaaaaattgcttagtataatagtgagtacaaaacaataatttgattattgatattttacataaacattgaacatcagacaaaatctaaagactaaactaagtgtgaaaatgctggcagggaaacgtcatgcctttagtgatttagaatgtgctttctttcctacttctcacccctaagtctctatctcaattactgttacaaagacatgcttttaatgaagtaatatgaactcagaaataactagaagttctgttaatgagggacagaattggcctattcaaacattactttctacaatttcctgaatgatctggcttattttgagagaataagttgattatacatgaaaaaaaaacctaaaatacacttttagtccataaatgttaatacaattattagggagaactggatagtatttgacagggaaagtaacgtggttacagaatgtctctgcaaatggttgtctcagtgaggaaaacatctgttagataaacaccagatgagaaattccatctggctgtttcatggtgctgatttgttcagaactgaattttgcatcgttaaaccttgggtgccaagctctgcaagacacagatatgccttttcttttgattctgaagctcagtgtttgcatctggtaattttggagaataaactatttcaccagaatctgattcttgccaatatgcatttcacttaccaatgcaccactactgagaaggatcatgaacacaatgaaagtctcaaaccagttgtgctcaacaatactgtagcaggtttttcgaagattccaccagatcttccctttgccttcttctgtacttacttgacagaatggaaactttttaatacatcctaaaaatcaaatatagttaattaaaaaatatattttaatcttaaataggaaaaaataaactttcttgccccttccccactccacttccaggtaatcatttcatagggtaaccatctccttcatttcctagttatcgtcagcatccctcctgtataatgaattattctcagacttatatactcagccagctacttagaattcaaggaaatattttatctagatttgcttaagtaacaatggtttcattcttcaccaccagtcaggattattttgcctcaaggccattgatgaaaatagtccaggtgcatctctcaggtttgaggcaaaaactacatgttcgatttgtttattcatattttgatgtgatcctgggtttttaattcttttcatgcacacatgcacagaaaatctcgctgtcttcccaggcatcagccactgtcaattttccgaagctaatttatttttcagcctcagtgcttctcttagtcacacctatgactcagctcgtcagtcagtatctctttccctttgtcctccccctcctagctttcgcattatttctaactcccatccactcttctgctgtaagtctctgagctactactcatctgattaagtccagtcacattgaataatagatattcattgatttgtgttcaagacattgtgctgctttctgtgagaacagctattgctttccctgccaaagcttcacaatacagttacatctcaaaacagctctagccaaagcacattaaccacattggaactgtaagggagggaatgtaattactgtagcatctataaatcaaatcacaccattgccaaggagttctgaagggattacaatatcaatgacatgacattctagaatgccatttatctcatagggtcagcttcctcacattatggagaatgagaaaacaaaaagacctatcagatcattttaactgtccaggaatagtcactgccataagtataatccagaaatctagagagattaactttttaaaagacaaaaaaggaaaataaagataaacatgccttcactatttattttaaatatttttcttatttaatttaatttatgtatttattttgagacagggtcttgctctattgcccaggctgaagtgcagtggcataatcatggctcactgtagcctcgactccctgcaaaagctctaagatacagctgtggctgaggtagcagcgactacaggcatgtaccaccatgttgagctaatttattttttctttctttatttttttttttgtagaggcaaagccttactacatttcccagggtggtctcaaactcctggggtcaagcaatcctcctaccgtagcctcccaaaattttggggttacaggcataagccaccacacctcgtttcataaatttttttttttaaatgaggcatattcagtctccgtaaagaacaaggggagattgtatttaatcacatcagagcttgtttaccttcagtaaaacaagcttccggtttaaggtcttcttcgggttcagtttcagcttgttcaccttctcggggtagaacaacatcaactgtgcttccttcagatgagctggttgcatttaatttctggaaacaaaatcccatttcaaagatgtgattttcccccttttatttaactaactgggaaatactgtgtcattgtgtgaaaaaaaaatagtagtgatagcatttaactctattagcattactgatcattatgtactaataatttaacataaatcaagttgtactattcaaaataacgtgactactgacctgaatcagacaaaaaaagtttagacaacattcaatgtgggtggtctggaatggatggattatactgattaacttgtttaatgatctgcatttgtatatgaatgccatatgaatataacttaatacattgaggccaaaccaagaatagttggataaagtggtatgctgacatctagccatgattatgttaattaaaatacatcaaatcaaatttttaatttccacctcttcagatggaaattttcaaagggcaaagaatattaccagttgtttctaagtattgtccatgtttctataattttagaaagaaagagcagcacattaacattagtcacagtcatatttcaactttgagctctatttttctctggcttacataattttcttcttattttactagaagaaaaatgatggatctctctctttttttgaactgcataactgaattcaatacttgtcaaagaattctaaatgaaatggaaatttcctcataaatggcattgtccagaatctctatagactttcattaggagcacattctgaattcaatgtgtgatccggctgtgaatacttcctttaactaaatcattgtgacatgccacatggctagaagagccactgtaatattacaagaataaataataagtactctgagatcacttgggaagacaggattgtgcaaagttttatgaaaacagttgcaaagacatgacgcacagcacaacctagataatgtaaagcttttaagatgaaacaatagtgcatggacatgttaatgatttcaaagcccccattaactttggtagctgagtgttagggtcactctgccaaagccttctgaaagagttactgtgttatttttaaaaaggccataaacacagttcatgttggggaaatttggctcaaaattcctgatttaatgaagacgtaatgcaaatgtagtttaatattttacaatgtgaactaattaaagggtagtatccagatgatactttctgtggtgttactttaaagttgatattaacctgacattagccatgtccaaatatatatattatgaaaattactttaagtcaaaatacagttttttagtagagtacctcctaggttggagtatggtaaatagagaagctaggccatcacttttggctgatagttcttagggtcatgatagcacaatttttttttttttttttttttttaccattaatttcctctacattatggagaggtgggaaagccaagacatcttctcctctcctaggatttttctgcttcttatagccaggatatttttattcatttaagaaagacctaggaaaattactgctgggtagaattgtagcagcttctggtgtaactaagaaaatactggataattgtttggtctcagccactttttcttccaatttcactggtagtttatgggttaattactatggcttttgatgagtgacagctattaatatccactttataagtaataacaataagaaaccaaagtatttgaggttagttatagaaagtttcatgcttttttgtcctcttggctaatccaaacttaataacttctgagccttatcatagtaaacctcaacttcctgtatgaagccattctttcttgcatgattttcttcatgctaaattttatagagcatttaatctattatacttgtttcctttgactaaatattctcataaatatatgtacatatttacatacatctatatatacacacacgtataccaactacatacatatagacacatatatataccaaaagatccagtgtatcaccaagtatagaatagacactgaatagttaagttgagttcatgaagagtgaatcgatgaatgtttgaataccttttaatgtcactttatagagagaattatagtctttagataattctatctctccattttgatatataagtcaagtctggtcctgaaagagtctatgtaattatattagaaaatgcattgtcttattaaataggaatgatttaataaaaaataatatgttaataataaaaaagtaattatacatgtatacacacacaggtacttttccatttgaaaactttagaaaatatactcacccttcacttcccatgttaccactgctaatataattgtgagatgtttaatttttcacattataattcttccatgtattctgcaggtgtcttatgtttaatacaaatacatacatatttaaagcaaatcctttacagcacaagtcctaataaccactaacctgaatgacaacggaatcaatcgtttacacatatggacctctggttgtatttttttgttattgggaaggtcattagattacatatatttgtgaatgtgattaacttgtttggacataaataatctctaatagctctggaggttatgtatttatacatcttaagatagagagggacagtgatcacagttcacctctctcctcctggcattatgaggcacaacatatcttttgacaatggacaaggaaaaaaccctgccaccattctgctattgtccaaggagtagaacccatttcatggagaattgctttacagttattacagagattttctgattataaagataatcttccaggctctagaaagcccctcaaggaatgctcagagggaatcttggcaaagcttttgcaagctcccaggactcttatgaaccaaagcttagaagacggtagattagtttgcatttcactaaaaagtgttttatgggaggcttccttatctatgaaggttgacataaagtcagttttcccaagttgaagaatctgcctcagtcatgatttaatcttttttttttcccccttgggacagggtctcattctgtggcccagactggagtgctgtggcatgatcatggctcactgtatcctcaacatcccagacgcaactgattctcccatctcagcctcccaagtagctggggctgtaggtgcatgccaccgtgcctggctaacttttatatttatttatttatttttttgagacggagtctcgctctgtcacccaggctggagtgcagtggcgcagtctcggctcactgcaagctccgcttcctgggttcacacaattctcctgcctcagcctctctagtagctgggactacaggcgcccgccaccatgattggctaattttttgtatttttagtagagacggggtttcaccatgttagccaggatggtcttgatctcctgacttcgtgatcagcctgcctcggcctcccaaagtgctgggattacaggcgtgagccaccgtgcctggcccacctggatgatttttaaattttttgtagagatagggttttgccatattgcccaggctggtctcaaactcctgggctcaagtgattcatccaccttggcctcccaaagtgttgggattataggcatgagccactgcatctggccaatttaatcttcttagtcagaaatgctactacattattttttaatgccctaggtcacatatttatcataggaaagtacctatgttttaattgtatgaagttatgaaaatattgtatcaaatttctaaagttatgcatttacctacatttataaattaaattgtgaatcaccttcttattaaattacatcagcttacgaattatgatctactacctgatatgctttagtcactggatacataaagaactttactgctgtattttttaaatcactaatgtacaccctgaaaaactatataagcattttaaattgtatacatttatatgatacatatctatactatatgcataattctatacactgatataatctaaataatctaaacattttctaaataagttcaacactttggcattcacattctagtcaagggtggtttgtgatacatcttattatagccataaccaaaatgaccttcaaatttatttaaaagcatataactgatttaaaagcaagtgaccaataaatataaagaataacttactttctttatattgccatagctgtgatactacaatgatataaaaaagcaaagaaacctgaaattaaatttaccatattaagaaactagatgactatactaaataactaaattcatacttgtcctgaagtagttagaaaaatataattgggaatataggcataataatagaaagcttccatataaaaccacatagtacaagttcaaacttgttttcttgtactattttctccctactcctccaatattttatggcacttaaaggttaaatttttccatcccttgtagaaacgagtgggtctacagagggatgatggcttatgctctacaaatgcacgctgaaaagcaggttttaagatgcaacattctccaggcctaattcagccgcagaaaacatgcctggctgtagcagaagcccggcgcaatgctgtggaagccgcacgctgatccaagaaccatgtcctcaaagacatggtacctgaatatgaagttttcaagaaggttaactacaaataccactcacaggaatgggttatttcaacataagaaacaatagagttaacacccaaaaaaggccacgagaccattccccgccgcccaatagagtgaccttatatagaaattcccccatatgacaaatattgctcttgatttttatccaattaaataatgaaatttaactttcagagatagaagagaatgttagcaactggcctacttccactgaaatgcgctcacatttcatttattttcaatcagctatcaaatatttgactctcacaaactgctgtatgattcaagaggcaaaataaaagattcagccattacagattgcctttaaaatctagccatttctctaaaaagttgtggatttttgtcttgctagtagaagaggaaagttttggtcatacacactatcagggccttagtctgatcttttggatatgcataaccatatcttgacttatgatatttcacctgaaaaacaagacagccacacagtgaagccattgggttgcttgtcctaggcgggaaggaaaaggccagtagctcttttttttttttttttcacgatcacttatcgaaagattaaaaatatgaaccaccaccatctggtttgcctggacatatattaaatgtacaacatccccggagcttcttttatttttaaaatagcctgaataagaacatggtatgtgaaactgaaaataattacgttgtagttgaagagtagggtaaaagagcatcaaaaaggaaaaagaaaaaggccatttgttttcagaaaggatacaaaagtattcgtctgaaccagctttaatttttttttttttcagcagaagtacactaaagcaccaagaccatctttaaaggttgagatgggtttaaaatggctattcacacacccatctgctcctctcaaaaattatctcacattcaatttcacaaagagcatttggaagacactggccatgtaacagagaaactgaaagctagagtcattattccattgctttccaaattccaaaaatagcacaaagtcatgtccagaagggcatgtgctccggaccttagtcaaacatctactttcaaagtttccataaagactctgaaaaggagggaatcctgttataaacacagtgtaaataataatatggcagtaccatttaattctattctgctggtgaagaaaaaagaaaaagaaatcagattttcttcaatgactaataatgttgttttattctaaatctaaaaatttggtgctgaataaaaattgcataaatcaccatggactgtatctttgttactattttccattgataattttatttctcattttttttgcattctgcaactaattctcagttatccctaaggaaaataagactatgcataaattaaacctagagacaaccccaaactaattagatattccttgtcaccagaagccttgaaaactgcccaatatttatgaactctttacatttccttcaaaatttccctcccagaacccgcactctggctgagattccagtaagcaatggagaaagttgagtgaacagaataaaataaaagctcattacgccacaaatctacaataatcttgggagattccctttactcctcacaaaactaaaattaataattaataactgaaaatagtaaattttccaagtctcttttttgcctggtcagttttggatagaacatttagggagaaattaacataaatcattgacatttcaaataacaaatgggtacactaggccaattacttaatgatcaagatataatgaattttcatcccatatatcatgatgtttccttttttaagttacaatgatcactatggttttgcagacataacttttcccaacctacatgaaaatccaagatatgtgttgcccaaatgcatacagactatggcccttcatctccaaacctcaggatcaccctattcttttttttttcttttttctttctttcttttttttctttttttttttttttacagaacctttcccccaaaacatgaaagcaaacattttcatctggagcacatgaattggataggctgaaaattatattcatagatctgaatataatgatctgaaagtggcagtactatcagaaaaaaaccctgtgaggcttattttggtaatacaatttacttataaaggctgaatcaacaataaaaagttgtggtcttattttaatgaaataaaagcagagaaacaaaaaaatgcatgccctcctacatccctgactatattgaaccataaacattcctatcatgttttaaaatagatattacaaatcctatagagcatgcaattggttttaaaaggctaaagactaaattagaaaactcattagcagaattaaatatgatgttgggattgcccatctcgcctgaccatgctgtgatgtgtcacacgattcagcagagagcagctgggcaagtctagcacttccttgccatggcaggggaaggaacatagctgagtagcatgcaggccagtcaaaattcatttagaacgtgattgtacatgtacaacttgcttggataacctgggtaaaagtggtggcacgagcctctggctggttaaaaaacaccagagctgcattcttgatggctccagcttgattttactcctgtgagaagtaagaatggtaagcagtgaaggtcacagtatgatattgctagattgtgtttggaattcaacttcaaatatgattgttaaaagcatttattctatatccttcacttaggaagacaaaccaataatcttttaagaattaaattgcaaaaattcatagttatataagtatttcaagaaattatgattatgagaacttaaaaaatataaaaacaaacaaattctacattagagctcctcaaaaagattcgcataattccaagtttttgcaagattaaaaaaatcactattttgaaatccatgccttcaatttcctgaacttttttcatgcaaaagtttatatttgcttccataccagcctatttatgttagtggtattcatatatacagatgtaatatatatacacacatatataacatatataacagcaattcccatgtttatctctaaaaacttctagggatcatttctctttagctgcgatagtcaggtatcctttattatgaaaatgaacagaggaaatacagtaactagagtttccaaataccatctaaattaatgattaatttactgtctcctcttcaagcagacatttcatgcaagttttttagtgaaaaatgtataactctggtgggtttaacttatgtgagtgctcactttattagcaaagaggaaggatattctgtgctctgcaaagtagagttcaatgttctcttgctacttgtgtcaaaaacctaagaaacatgaaccaaaatgtcactttatggatatgttattttaaatgtgttcgtgtgtgtgatagctattaaaagggaataacccagccaatataagtgtgcacctgaagtatgctagcagcttttggaaatttcaaatcaaaaatgcactttgctagaactcatttaatctgctctatgatattagaacatgctggtattggctttttattttaaaaactgtctgcattttatcttgtgtgtgagcatatatgagagttccctattacttttttggtgggtttttaaagtattcattttaccaaatcattcatataaaatttattgttgaatttaatattactgtgcaagataatttgaaattttattctagctttataaaaatatatacctttatatttgtttagtgattttcccactaacatatttatatattttaaataatttctttacattttgtaattgaaatctatgtattcaaaatttagcttgaaagaggaggataaagtagttatttaaatcaccccataagacatttttgttcaggtaagaaatgttttccaggtacataacaaaggagagatttatatcttgttactctaaatttattatgtttaagccattaaaaaggcatgataattagcagtcatttgaaatatcggtggtcattatgaaattttaaaaatactttggaaaccaactgttcggtaggaggaaattaagatatttactttccataaatctgatgtcaaaaaattctatcgtattaatctagaaaaagtttttctatcttttagcttttctacctcttttgaccctaagtttttatgctactttgtctctagttttctcttttttctttcactttataattacttatttgatgagctcctccattttcagggaatcaggtaattataaaatctgcattatcaaacattataccttatttttaaaccctgacctctaactcagactctgtttcccaacactgacacttctaattcagtatatcccaattgaactccttttccaacataaactgggtagccctttttaaagaccatttcagaaagtggcattgctgtttttccattttcccaggttctttagtaggtttgtcaagttgccaatgagtctcaattctcattacttattgccctagctgagaattttatcacctcattgctaccgaatgattatcaccatattccccaagataacctttcttatctttcactctaaactgttttactctttgatatcaaataaatgttcttaaaataccactttccaattgccttcccctgcttcagaacagaaaatagctccctattaactccaaactctttggcttactttaaaactttataatctgaaactacctcacacattcaaacatattttccactatatattcaaccaacacttacctcatgtagattatcactgcatgataatctgcaatgataaccctaaactgtctttaataccaagctcactgtcagctccacctttcctttagtaagcttcagcattttgctttctgataatgtatatttgacccaaactttgaggtctatttcaattttatctcttccatttagcaattattcttgctctcctcaatacctatagcctcacatgcaacctgacaggattaaactttttttttttttgagatggagtcttgctctgttgctcaggctggagtgcagtggcgcaatctccgctcactgcaagctccgcctaccgggttcacaccattctcccgcctcagcctcccgagtagctgggactacaggtgcccgccaccgcacccagcgaatttttttgtatttatttatttattttttagtagagacagggtttcaccgtactagctaggatggtctcgatctcctgacctcgtgatccactcgcctcggcctcccaaagtgctgggattacagacgtgagctaccgcacccagccaggattaaagtttttaataggtctttaataatttcatgagttcatgttagcttactcaaatatgtcaagatttccttgaaggagagttttgttatagagctctccttcacccctagtatccagcagattgctgaattcacaaaaagtgctcagtaagttcttgttaattgactggtatttcttcttacataaattcatgccaggtgatgggaaataaaattagagttgaattcttagtttgtcagaatgagcaacataaattagagttgaactcacttagcagactttaaatggaattcagagaaaaaatatcactacttaattttgtatgtattttacctttttcaaaatattttccaacttattattatactatctttcagcaactctaaaatacctgaaaatagtcaggaagctatgagttgtaagattgtcagctacctattatagggatttcagatcaagttttgttgatacacttatttaaaaaaaagagttccaaaatatgctcacgaaatcagacattgttggtttggttcccactgtgtcaacattataccctcaagccaaaacctgtctttgataactccatctgtgctagacttactttgtactcatatgtattaaacgtctataaataaataatagtaaagaattttaatcctcttttccacaacacaggattgaagaattaataacattactactatgatagaaacttaagaatactaatcatgcagtaggaacaatttccttccttccttgcttccttccttctttccttccctccttccctttcttctttctttcttcccttccttcctttctttctctttttcttttctttctctttctttatttcttccttcttttctttctttctttccttctttttttctctttcccttttttctttatttccttctttctttctctttccctttctttccccttccttcctccctccctccctccctcccttcgttccttccttccttcattccttccgtccttcctccctcttctcctttccctcccttcctccctccctcccttccttccttcttttttctctttcctagtaacacaacagtaagagtaggtttattaacctacaaaataactatagccctcaagtgaagcttttaaaagtagttcttagtattttcaagttactctggaagactatagatctgctcatccttgactgggcaaaatataataagtactacttgtactttcctaatgtgtataacactttcataaatgaaacactatcatagtgaataagactttcagaggttaacaaaagtacataaagttttcacataaaaatcatagcaaaacctaatatagagagtaaggagatgacgaaaataagttattttttaaagaacataatgtagttgagagtgtaatgtactaaataacatctcttttttggaaggctacttttttttgagatagggtcttgctttgtcactcagggttgagtagaatgatgtgatcgtggctcactgcagcctctacctactgggcttaagcaatcctcccacctcagcctcctttgtagctgggactacaggcatgtgccaccatgcccagtgaattttcgtatttttttttgtagagaggagattttgccatcttgcccaggctggcctcgaactcctgggctcaagtgatctgcctccttggcctcccaaagtgctgggattacaggcatgagccaccatgcccagcctaaaaggccacattttttaaccacattttcaaatgatcaagaaaatgaatatactaaagactcagaatggtttaatttcctgtgaaaaattggaatttttagaaatccatttcccaataaagagtatcttgtgattttccaacatcactatagacatatgactttcaatattgctttttgataatgcatataagcacaatgaaaatagtaaataactgtagtacatggttatcataggaaatggaacaaaaaatttaaaagcattcttacctctttgctttcttctagttctgactcactgctgaactcttcagtatttaagttttcaaagtcagactctccaacagcaattggcactgtgacggtgaggctggggttgtttatgaatgacatataatcattttcatcgattacgtatttttcaacactgcttccagtacctacaccactggtggttccattcccatctctaagataattaagctctttgcttatttcaattccagtattattggacatgcagctgtctatcttattgccttcatggatttctataacttttggctttctaaaaaaggctttttggaaacactcccgcatcttatttttcacataatcaattcccttttgcattcttcctactgcaatctgcagattattcatttcattgtcatcatcagtagcagcaaggttgtctgagctaaatgaactcaacaataaggccagaaagaggttcagaacctaaaagaaaaaaagaaaaatgtctattttaatattgaaatatgcatttaaataacagcctaaaaagggaactcatagatctttgctaaaattatttcaacaaatgtttattgaatgcttactatatttcagatgccatgtctaagtcacacactctttaaaggacctaatatcctgctctaagggcaaaatgataaaacaagcacctcttctttttttcctattgggagggacaataggaaagcagagcttctaagatttaaatggtgtctactcaggtttgccagtgcaaagacaaaatcctaccctcaaggattctgccaacgagagagagagagagagagagagaaagatactttcttcttaatcattttatcttacttcatcttaccattttttttcctagggaatttctagcttcgtgtatataaagaatgaacttatttatttaatagcctgatgatatgttccaaatgatatacttgaaatacaaattcctttggcccaatggccacaaacttttataacagcagaaatttctaagtgcaaattatatacgatttaacacgtttcccatcaaatacactttgaaatttatatgttcaaatagctcaacagatggagagaaatctaaaagtataccagggtttaggctagacccacataagttacttttctttttctttctttctttgtgtgtatgtgtgtgtgtgtgtgtagaaagtatgaggcgattttaactttcagaatatcatgggatatgtgaaaaagttactcagccaactgataagttatggttaatgcaggaataattcattatttctgatgtaaaagaaaatttataataatatttttagcctgaaatgtagttagttattgagtttcagaatatgttacactataggaagacatgcaaggcaaaagccccagtttgcttccttacttctgtatcagattttttcagaatctagagctccctaatttactattctggagaaaaaaattacatgttcgtaggtatcccagtagcattcttttgaacaagtttatctgaaatgtatccctcaaaggaaaggcccaatatgatggcataaagaaatgctttgcccacgcatgactgagaaatttaagcattaaacatataaatatataaactatgcttttgcattagtgattttaagtcacagttaaaagtaactcctttgagtctggacaatgtccatacatatgaataatttaaactgtaataattggttttcctatagtaatgcaaattcagggaagaaaacattttgtcctcttccaagttacttggataattacaatgcatagctaaaatataatggtctacttcattgaaatgtgtcttcaaaatttggtactatgcaacctatgtctctaagtaagcaaactacatgaactatgaacatgcaaagagcaatttgattatagaatagatagttgtctttttagatttagtagaggtcattttcttatcaaaacaatattaggatacaattcttcttagtgataaaaatttactttctttgaagaagaaaggaaaatctaatatttatgcccccaggcattcataaatacatctgatttaatctttgcattaaagatatgatttcagttttattattccaatgtcataaaaaatgggaaaccagagcccaggagaagttaaataacttgcttattctctgagtgctaatagggggatttcagtctaggccacttactataaaccagagatatgtttactacatctggccacgttcctagctactgtctgctcttgttctaatttatgagcatttgtactacatacataccacaaggtttccaatgaccatgaccaacatgaaaacaataaggcacatggtttggccagcgacctccatacagtcccacatggtctctatccactctccacacagcacgcggaacacaatcaggaaggagtggaagaagtcgttcatgtgccaccgtgggagcgtacagtcatcattgatcttgcagacacattctttgtagctcttaccaaagagctgcatgccgaccacagcaaaaatgaagacgatgatggccaacaccaaggtgaggtttcctagagcccccacagaattgccaatgatcttaattagcatatttagtgtgggccaggattttgccaacttgaaaactctaagctgtaatcaagtgaaaagatgctgttagtagtaatcataatataattttagacattattttattagtatgtggtatcatagaaccacacgtggtagatgtaaaaactcaaaatatactgaactgattcaatttcaaatccagaaaaaatagtgttaacaatattagaattgtaaatctggtcataatatcatttaagtgcaaaaataaaaataaaacatttcagaaataataaataaaacatttctgattcatccaaagatatgcccatgtaaacaaatggtattttgattagagactttttaaattagcaaataaatgttatcttcagattctattttagacagtaaaaagaaatattaaaagtataaatcatagatttttataggccaatataaaagtaaaataacctaaataatgtgataaaaatgtacaggaaaaaaattgaaaaaatacacattttgcttaattttcaataaattttacatatttctcaataaaattttgtgataattcaaaaagttttttatacaattatttaagatactaataacatcaaatattttcccacatgttgctttaaaacagtccccattcctagaagtagggttaataaaaagctaaaattaactggggtctaaatttttatttgcgtatctttacagactgtaaggccaaaaaagcttcataaacttaaaacacagttttagaaagtacttgtaggttttctaatgtgccctacatacctaatcattatagagtattttgaatgctttcatcattcttagaaaatggtttagctttaaagaggatgtttacatgttttcttagaatgtcacatattgatgtaaatttaaaattaaaattaataattatataaatatacattgattcaatttcaaaataaatgttgtgccaatgagcgacagggatatatataaatagataccagtctgaatgatcgcagtacagacaatccctccacatttgacagaccaagctccattaaactgaggctgacaataattccatcaaagatattccagccttcttggaaatagtaataaggatccatggcaatgatcttgagaaccatttctgctgtgaaaatcccagtaaagacctaaaaaatagagatcagcactacttcaagagcactgaaaaacactgatgctacacgaatttataaagaagaacattaacaggaataaaaatatctaaaatttaaagtgagagaatgtgacaaatcaattcaagtcttagtttttttattttcattttttatttttatttatttttatttattttattttattattattatactttaagtttgagggtacatgtgtacaatgtgcaggttagttacatatgtatacctgtgccatgctggtgtgctgcacccattaactcgtcatttagcattaggtatatctcctaatgctatccctcccccctcccccgaccccacaacagtccccagagtgtgatgttccccttcctgtgtccatgtgttctcattattcaattcccacttatgagtgagaacatgtggtgtttggttttttgtctttgtgatagtttactgagaatgatgatttccaatttcatccatgttcctccaaaggacatgaactcatcattttttatggctgcatagtattccatggtgtatatgtgccacattttcttaatccagtctatcattgttggacatttgggttggttccaagtaattgcttcaaagagaataaaatacctaggagtccaacttacaagggacgtgaaggacctcttcaaggagaactacaaaccactgctcaatgaaataaaagaggatacaaacaaatggaagaacattcgatgttcatgggtaggaagaatcaatatcgtgaaaatggccatactgcccaaggtaatttatagattcaatggcatccccatcaagctaccaatgactttcttcacagaattggaaaaaactactttaaagttcatatggaaccaaaaaagagcctgcatcgcccagtcaatcctaagccaaaagaacaaagctggaggcatcacactacctgacttcaaactatactacaaggctacagtaaccaaaacagcatggtacttgtaccaaaacagagatatagatcaatggaacagaacagagccctcagaaataatgccacgtatctacaactgtctaatctttgacaaatctgagaaaaacaagcaatgggaaaaggattccctatttaataaatggtgctgggaaaactggctagccatatgtagaaagctgaaactggatcccttccttacaccttatacaaaaattaattcaagatggattaaagacttaaaagttagacctaaagccataaaaaccctagaagaaaacctaggcattaccattcaggacataggcatgggcaaggacttcacgtctaaaacaccaaaagcaatggcgacaaaagccaaaattgacaaatgggatctaattaaactaaagagcttctgcacagcaaaagatactaccgtcagagtgaacaggcaacctacaaaatgggaggaaattttcgcaacctactcatctgacaaagggctaatatccagaatctacaatgaactcaaacaaatttacaagaaaaaaacaaacaaccccatcaacaagtgggtgaaagacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagttaggaaacaacaggtgctggagaggatgtggagaaataggaacacttttacactgtttgtgggactgtaaactagttcaaccaatgtggaagtcagtgtggcgattcctcagggatctagaactagaaataccatttgacccagccatcccattactgggtatatacccaaaggactataaatcatgctgctataaagacacatgcacacgtatgtttattttcattttttatttttattatttttttttgagacagagtctccctctgttgcccagattggagtagagtggcgcgatcttggctcactgcttcaagtgattctccagtctcagcctcccaggtagctgggattacaggcatgggctacctaccatgcccagctaatttttctaatttctgtagagacagggtttcacatcacgttggccaggccagtttcgaactcctgacctcaagtgatctgcccgcctcagcctcccaaagtactgggattacaagcatgagccaacacacccagccatgtctagcttttttttttttttcctctaggagagtattttattaagtagagtggtattatttaatgaatcttctggatttccaagaaaaacactaattttaaaacatttcatggtctacattttaactctggtattgaataatagctactgaattattgcccttgttggtacactacatttctaacataatcacaaccaaatttatttctgggtagtatcgcatcaggaacaaatccacatattactgaaagttattaaaaattgatttcgtaaaaaccatattttgtttttgattttgtgttttttaagggacaccatcttatttctataattttataaacattcctgaaacaaaagtaagtttgccacaaattgtttattataatgatctctggatgtatgcctcagaattaaggttaatggattaatagagcaagaagctgcagatttaattgaaaccagcaggagaaaatactcagtatgcatatacatgtaattgagattaataagtcacttgagtggctagataaatgtgtatttgacaatagaaagaaaaacaatgaaacaaacacaacatttattttttaactcaaaacgataggctgagagatacaggacatgaagaattatgaaattactcttgcagaaaatcttttaaagcaattctcttaatttgctatagttacaagttgcagtttatgactgtaaagtcaagtttagcatttacgaagataaatcagcctttatcttgaaggaattctgtcaaaataacagtataacaattatttggttccacttaaaagaaatcttgatccacccttacgaatatataaatgcagctaacacttcattttttccaatcacagatgggaaatacccatcacagaaaaaaacagcctaatggtagtcatccattcactcaaatagaaataaaatgtattttaagcaagcctagtacatgaaaatccaagtatatggtgaaatgcccattgaaaaatatatttttcattttatagaataacacatcaaagatttttttttcaaatagtgagtttgcctggtaaatgtaaaataagttgtaactatacaaattttatttcatgtataaaacttttagaagcagctattatttgaaataggcactctgatgatagaaatatattatttaaggtgagctagaaccatccaggtaaataatctacaaatatctctttctatagaaaatcataaggtgatcttttcagctcttctaaaatgactagatctcatacctttaaaaacatataccctaaatttacgcttatctaaaaatgtaatcccgccataaaacttttcattaaaaataatatttttattacaactagcaatccaaaatgacagctatatctctgtaactgttttcagttaaggccctaaaaatcaatgggattgtttttggtacattttaatctagtttcagcattgtcaggtaagttggaaatgtttgttatgatgttgtctaacctactatgattgataggctattttttgctgattgaatccctatgatgggagcaagcattttataatgattaaaaaacaaaacaaaacaaaatactccacaaaaatacggagcaccttagcaaaacttaattgagattcaaggtctcttgatactcaaatttgattaatctcatcaacaaggaagtgatgtaatttttatgtactgcagaaacagaatgcaaaatggggcatattgatctaagttaagatggaaaattccacaattcagtgtcctcatgtagaacataaagcagtatgcaataatttgagcagtaataaactagtctgtagatattctaaatttattttaatgagcaaattataagctctccacaaaacattctgtgtaatcatctatgatctataatatagtcctaagtcagcttagcaccaatgatagaaattctttctttctctctcacatgctctttctctgcatatatattaaacatatgtattactttcatatggatatttatgataaaggttgttatgggtaggaaattctatgggtagatattctatgaacaaatgctttgtaaattatgcaatgcattattgatatgttaatcattatagtaaggaggtatcaaccaatagagacagtcagtttacatattctcctatttttatggatagaaataaataactcaagtctgttccctataatttatgctctctatcttggcaagttttgtttccccaacactaacctgaacttatagatggttctatcacaaacaatctaccaggcatcagtctcccattccactttcccacctcattatttcagttactacccataaagtcatagaattgtagaactgggacatacataaaaagtcatttagtccaacacactcattgtttatatgtgtgttgagaaaatagactcaaggatctaagtgacttttcaaaaccacacagatatttaccatgaacactttgactaggacctagatttgatgcttttgtctagtgctttttcattcaatcatcttataatccagcctctcttatcctgtgtttccatactcaactgcttcagcattggaattctatatttcctgcttcactctggcaaatttccttcacctgttcaacttccctaactgtccaatatcctgggaaaaatacaagaactacaccagaaatattttccatcattatttcaaagaaaggtctaaaaggttaatagcatatatatgaggaaggaaactgtttattgagcacatgctagatgccaggcacagtctaggtgctttcacattacctcatgtgaccttcacaacaactctgcacgaagggtattattacactcatttcaataatagaaaacaaagattcagattgtttatcagaattgtccagaggccatatcactagtaagcactaggcaactaaggtcaaactcaattccactccactgcaaagtctgtgctcttttgcaaaatcatgctacttgaagcagcctttttgggtagttatcaaccagtgggttatttattgagtgactagcatgtaaacactgagagaggcaacagaaaaatgggacacggcctttgccaaagatgaagaaaatctcaagaatatggtgggtgttctactgagtcaaataatgcagataatttgaggtcacttattagggcacacaattatccaattgtccaccagcatttcctttcccccttctgttggcaattgctccttcacgcatgattcctcaggactgccatgttttcaacatgatcccaccctctgccaaggctgattaaatcagaggtgagcatgtgacctaaattatgcctaagttctaccaggagagtctttggaatgagactcaaaaggagattcatgcttttcagtgtagaggttgtaggatggaaaatcagtgagctcttgctgaacatttgctgacctaaagacaaatgatgcagtgaacttgtgggccatatctaagcccttgatgaaaactgttcctaaagtcagactgcaatactgccctttacttagtttgttagtctaccttttccctccattccagtttccccactaccccttgccccaagtttgttttagtacagagaaagctcttgattaataatatatgtaaacccttttcttacttgttcacccattttgattagcacacatagacacagatgaatgctcagtaatttgaaccagaggtatggctaaatcacaaatgcaaatttagcaactattttttttcttgtatgattatcactgaagctttttattaggtagttaacttgaaacaatgatgttctttttttcatatacatcaatctttgggtcatcccttcaatggacatgattgttttagaggctgtgtgggttaaaaccacatgattgtggagccagtattagatctcctggtttatctggacccacatttccagcaagaacaactgtaaagattttgagacgtttacaactggtaagacaccatgatcaatcagcacagacattggcctaaacaatcagcattcataccagttgagttttaggctgtatctctgagattccctgtaatattccttagatatttctttctatgaggaaagaggatataatttttgggttcaacacagcacaaatacatctttccctttggtctatctctcccacatctaccaaagtaaataagtaaacttcaaatgtacttaccaggtttcctacagtcaacacactactgaattgctcagtcatggggtagtgctccatggccataaagagggtatttaagacaatgcaaatagtgatggcaagatcaacaaatggatccataacaattaaattcacaagatgttttacttttaaccatgcatcacagcagtcccagatcaagaacacattggcaaatctataccagcatggcggacatttctgtctagattcttcaagttctggagggacaataacaaggaagagtagtaaataacaacaaaaatgagttattattgctagtagattttacattatttaacaaaattgatgcttatatttgaaaatagaagttcatattacttaagaaacttgagaagacaatcccattaaatattttcagaaaatgttaattaaaatgtcatatagatcgacttttttctcttttgaatacagaaaataagcactttgaatttaatattttgcttttaaaatgactaggttatgattgattaaagtgctgtattctctttgtcaaaacagaattttaaataaacattacacaactattaaaattttaaataattattgtttcttctgaaagtacctttttaaaaacattgtctaaagttgtgatcccttatgtgtgtgataacatttatgaactattctctcctctcatagtttccatatcaacattaatcttgcacacagtgagaacgtagtatgcctttctttttagtataaattcagactcaaatctacttttgtggtttgtacatatcttttagaattttagcatcatgtatttaaaatattgcttgaaattttaatggatgaggcctgttacaaaataattattatgtgactgtatatctaatacaccaagaagacatgatataaaatgtaattgatgttttctaaagaacatatgttagaattgacatataattgatctaaaaagggcagtactaatatattctctctccagacttcaaggagtgagggctgtgtgatgtatgaacaagtttagtgtataaatagttgctgcctattcctctgtgtcaaaatcaacaaacatttctttccgtggtcctttggaggaatgtaatggttgctgtgtatgtagaagatggaagagagacccttttgtaggatctctcttgcagtggaggacaggttttgatttgcccaactcatttaagtgctcccgcaaccccatcaacacttccatgcctgaagaacagactaaagcctgaaagaaatgtttccttatgcttctatataccaagacttagaaaaggggaagagtttactctatttgcatatgagtaacataacataagaataaatcctcattgatataatatcaagtgttgaaatatcactctgcaagtaaggtaaggacccaagtcaaaaagaaataaggccaatattagtttttgtaatcaatgtgataatgtactccatatatcacattcttaggtctaatatatagtttcgatctgggtaacagacttcagtaattctatgaaaagaaggaatagttcacaaagcacataatcacagaaagttggctgttccatgacctgcttcttaccttccattgtgttggtcagaatgctggctatgctcacggctctttgccttccagaggaatcctccagcatctccattgaaatctggtaagagcttaaccttctctttctgacttccgtttctgtggtggtgccctgcaaaccaaatactgatggctcaaaccactcttcccaataagtaatacaacaccacatagcatttctttggcaaatcatgctacatgcaatttttccaggtaagaattttcaaggaataaaatattgaattattgctaagttataaacagttttttttttaaaaaaaagttatcacaggtagtactctttaagaggaattcaccagtgggatgcagttttataacacaattatattacagaactattttaattaacctgtcacaattttcaaggaaatttgttgtaaacatgctaaagtcatttattattttatttcattcaggtgaaaattatttttatcttctatcaatgattaataatcagatcaatctccccccaataaatattatgattatatagtctcaaggctgaattattttctttgaggctatattgacaatattgacatatgtgggccaattttttccatgcacaaacacagatgtacgatgaaatgtgtgtgctttcctgaaatttctttaattatttctatatcttatcctattaaaaaacaacacattttagagtcattttaaaatagcactgtaaatattgacagttgtatgaaattgcccattatcaacaaattggttataatatttaattttaagaatatgaattttccagaatatgaatagataattatacaattcttggtgaatatacatcttatagatttgatggtgaaaatgtccattatttgtctcggtaggtctaccaaatttgcagatatgtatttcatagcagactctaaaaacggggcccttttaacctaaagccatggtcccttacaagtaattcccatacaacaaaagctaatggtcccatacaattcaattgattctcaatattctattgttttccctttgattaatcatgtattatttttaccaactttcattttgaggaagcaggacggtatgacagcctaaactgtccaggctttgattatttcaaattggtgaataatgtcagtagcagctaggtcatctattatcacctctgggggaagttgtccagtaggtgacgttagagctgaaggtccacccaccaaggaaaccacaccattgcaatccacagtgctgtgcatcttcccatttgctggaagccctggcaccatcctggatgacatactggcctgactaacgttactgttgcgtcgctctccatgtctgtgcggcacaaacagtgagtctctcctgctttcgctgtcttcaaatgtgctgtgttcatcatcagcaaagtcattttcagatccaacatcctttgcccgacctctgaaactgaaaatgcttgttttgctattgcgtcttggggaaaacagggagccacggatactcaagagagactgcagagaaagcaaaaaggaaaggaatgggatgggggtaggggaagaacgcaattatttaataaatattaatattaaaggatctgttttctttggagttagtatactcttgctcttaaacatggataatcaaatttatagaggacacatatattttgatatttttattaaagcaaatttaagtacaaagagtgtttttctgactaacaatactgatttgcaatttactaagtatacaaccacttcatttagtcttcactttaggtggattgggttatcataatgctataggttagggaccagatgctgaaaaggataaatgatttcttttgatgggaatggtggttaaacaaatagtaagtagcttctacttcttaatgctataatctgaagggaatgtagcctggagaataagttttggctcaagtgagaatgttagctcaaatttaaaatatttgtttcaaatgttgcattgtagccaatatttcacttcaggataattacttttttaaaaaactactatttttccattctcttcttttgaattctgaaagaaaagtagtttactctttctctgaaactgtttgtctctacccacatgggaacagaagtcacaaaacttacctacgatgttgtcttccaaatttgctaacagtttcccaaatggcaaccaatgattcaccttatttgagagactatatgtcatagcaaacacaacacagaggattcctaaactgctacacaaattactcttcttgtgtaaaatataacactggcttgtaaaagcaagacatataacatgacttcaccagcaggtggtgtgaaaaacaacatatacttctgttttattttaattatattaaaaagaaagagacaattcaaaacctttttcattacagctattcccagataaattaagcaaactatttcctagtaccagaaaatgaggatttagcttgaagttccttctttcacattttgaaaggattttaaactagcaaccccaaataattctgtgtgtattcttgtcttgcagatagttttcaaaaacatctctattcagtctgcagaatatttgttttctcccctcatcatgaacaatggcattcctccttgctctctcattccctttcctacttctcttcacacccagggtaatatacatacatacatatacatatacatatgtcagcagcaaacattcctggatcttctctttcttctaagctttagtgtaaaaccaaataaaatgattttagtggaaaaaacagaaaaggcagactctgtcaaatgtattcttggttcctctgcctaattaggtcatgctgattttcttaggccccaatttttagctttattttcatggcttttcccagactgcaaagcaccagaataatctttgttgtcctctgtctcagtgatattctggaaggatattattcactaagaagtgctctgttcctttggatttggttagattctccacaggaactattggctgtccagcttgtccatcggaggctgtgtctatgtgacactcaattcctgtagcaggtttgtctaccgaagggcagacaatagagtgattttacagcaaagtgatcaagagattagatcatgtgaagacatcaattcatccccccattaataaagaatgctaatgtttttcatttcctcagactccatttaaatgatcaatataataacagttatatccagaactcgtgttgttgttgttgttgttgttgttgttgttgttgttgttgttttgaggcagagtttcgctctgtcgcccaggctggagtgcagtggtacaatctcggctcactgcaatctccacctcccaagttcaagctattctcctgccttaccctcctgagttggctgggactagaggtgcccgccaccacacctggctaagttttgcatttttaatagagacagggtttcaccatgatggtcaagctggcctcgaactcccaacctcaggtgatctgcccgccctggcctcccaaagccctgagattacaggcatgagccaccatgcccagcccagaactagtgttttgaaacatttgagtgtatgtgaatcactctgagagttaaaaatatatatttttaggtcccagattttggaatatggattcaggaagtagcagataggactctggaatctgaattttcctgacacattccaggtgaccctaacacagggtggacctcatcctacactcagagaaatactaacttggtcttacattaatccctaggatggctgagtataatcacctcaatacacctatgttctgaaactgtctctggaaactgaaaatcggtctacacagtattggttgggagtatgtggtacgtgtgtacatccactatgtatctgggacatgcctttaatttggatatttttatgtcaggtattttcaaaggcgttccagatctctgagtttatttgaaatttctattcactctttggaatgtataataatgggtgtgagcgcagctttcaaggcaacagagacggaaaaagaagataacagaaatagcattcagagaaaataaaccaaaaataacacactagaagatgcagcagagtggagggaatacccacagctgtggcaacactttctctagggaaaaccagctttaatgttttaaggagtgaaaggccatctttctttacctcaggcatgtcaaaacatatttcccaggtatctttttcatcttgttcccagaagataaatgtagactgtttcttaattttcagtaacaaaagggaaaatagaagaaattaggtctataagacacagtcatgcatgtagggtttggattcaaagtgggttgggaaaagtcaagatggaaaaagatgctgggaattttaagatgttctagtgggaacaaggaaagtgaatatttgtcagaagtacttagcattttgaggtttcattttatacttttaagtatttctttattttgtacaactaacattatctgtttaaaaataaaataatgtaataaacataaaataacatttgtaatttatgtgaatagaaggcagggcacccacaatttatgccctctctgctttgacattttcagaagatacatttgatttgagcagtatttactgtctatcttacgcttcctgtccccaccaccttcactgattctctttctaccagattccttttttgtttacagaagcagaaattgtaaaccgtttatggtacatttctgcttgttagttttgttaatgctcttagtctgtctttactgggatatgcaaatttaaaactaatagattatttccttcacttttgaaattatccatctatcttctgtctatttacaaatataaaatgagcgacatctaccacatgtatgtactgattctgcttttagtattaaaacactggccatcagctaagctctctgctcttgcctgtctgtggttcactcagctccagcaaaccaagtctaccagttgcttcttaagcactccaggcatgctaccatgtcagggttttgcacttcctctttcatcagtttagaatgctgttccttaagagagcctctttctttgcctcctccaaatctttcccaaaatgtcttaatagtgaggtcattgtaaaccaccctatttaaaattttacctccaattatggctcctgttcctcttttcctgcttacttttttttcccttaacatttgttaccttctaacacagtctataacttatttattttattcattgtccgtctcctttggaaaaaatttccatgaggtcagtggattgagtctcttttattctttgaggtattttcagcatcttgaactatgcttgctacatagttggcgatcaataaatatttgttgattggactgaatgaactgatctacaaaatttatttgagcaaaatgatgaaacaataaaggaactaatactgctatcaaattatgtatatacatttgttagtaattgaaactactcagaagtttgctttccctcacttgaaattcattcaccgattttaacttaataagagacttactctttgtcacacagattttctatatattgcttagtcccctaaatctctttaatgtaggtattcttactttattttacagaaattttacaaagtacaagtgacttgaccaacgtcacagaactagtttggagttgagatatgaacacaaaagtttgtgttcactgtagcatcattatgctatagtttcatatactcttaattctaataactcctaatagttttaagaattccaaaatatcaaaggtgactgtttaagaaaaaaaaatctgatctgaggaaccaagttgcccttcagagcttcaagttaattccaaatatgttatactgatttgataatatattttatatttgtattacacaagatagtaatagttgaatttcttgatattgatgttatctgcagaaaaatggctttatcttaaaactctttgtgtattcatgtccattttgttctaatatgagaatacaagttttaagttattaatatagtctacttttttctttaaaaatatttgtttacatattaaagatagattataaaacattcactgagaacttgcatattaccttttctcccaaccaaaagtaaatactatgttgaattttgtgtttattacttctggttttttttagaagtttctttctttatgaaaaatatatcataccccttggttgatttgcagtttttgattaaattaatcttatatattatctctcaaagcattatttttagggtataattctgactcaagattgttatgattagaagcatttgcaattcatagcacatgaaattctaatggtgccaaatagtgttcaaagccaaaattgtacttatcacagattttgtaactaattattctttacatcagacatatgtaaacaatacattaacttactaatccataaaacttactaaacatcaaataattgaaactagtttttactcttttacttaaaactatgctgaagaaccaggtagttggcattaaatcagagcaaaaatagactacctttgatgctgttctcttcaagaacatttaggtcataatttcattctaatgtatcacggcatgaccctatgcaagcaaaatggagactcaccatagtccagttctcttaatcaaaggataaagacaaaacccaaagaacacttcttttcaaaatttatatgtatgttacgatcacaactttggataacaaaggcagaaacccattctcaaagaaaataagtttatctggggtctcaaaatggaaaatgtaaacaagagattccaaaactctcattgaaaagtctgctagtgtaggttatatatatatatatgtgtgtgtgtgtgtgtgtgtgtgtgtgtgtgtgtgtatagacacatatatacacacatatatatatacaggttgatatataggttatatcaatatatattatatatatctatatattatatcaatatatctatctgtatatataatcagtctcaaaatggtgaacattttattaatggtttaataaaaatccctttgaagacaatctattataagaatttaaacaactatattaaatgttagttccctgtccctcactgaagtcagatagtacaaaagtgtaccaaaacaaaatacaaaaactaaaaagcaatagcaatgacaaagaaaccagagcacttagtagaaaatcatacctgatgaggggagcagaattttttgtcactggtcagtctgtttccatccatggagaaaaggaagctgcttcttttgacgctgtcttcagattcggatttgggaaagctgtctctctctcctttgttgtttccttcaaggtgctctctctgtcttcttttcttccttcggttcctccattctttagcacttttggaactcaactttgatgcttctgaagaactttccaacagctctcctaacccacctattccactgaaatctcttgaagcagctgatgctgccgcaactgcctgtcataaaacaaagccaggcactatttagaacacagagctttgaaaacagttgagtatggttaaaatattgccatttaagactcattaactacaagtgaaaagtctatcctctagtccttttattttgtctcaccacaagagtttacttaacaatgacccttatgttttaaatcatataaagcaatatgctagtgtatgcattaaagcaagaaaaatctggttttgcctatcttctggattgtcttttttttggggggggggggttggtgacaactgttctcttcaaagtgtcttctatactttaaaaagcaaatgttttcttcgtggtggttgcttatctaactaccattctgattccatctgtaaaacgtttcctcctgtgtgcacttctgagcagctgagtcgtattttttcccctctaaatccagtacaaaagactgtttcttttattttttgtgaacataaaacatttcaagtgtctactattttacctccagatggaagtagggaaatgtattagatagcttatcctcttccttcctttgaattacatttaggactgtagttcacatctctgtgatcatgttactcccagagaatttattacatatcacttaaaaaatgttaaacgttcatagattatttaatattataaataacaaatgattaacatagcattacataaattcattcaaaggattatgagaactgcttcaaatattttctttctatattgcagcactaagtattcttaagcactttgaatttctgtacctacaaatgaaacacagtcagctctgaggtgaaacatggcaaatagtatttttagactggaaatgatctaacaatgacatacagaggatatgaaacaatatggtgtgcatcaaagctgagttctcattaagtatattactatttgtaaatgtaaccacagaagtgaaaataattaaattatgacaatatcagttaaactttttacatatgtcatcactaaatacaaacaaatctaacttatctaatatattatctttcccattaactgtaagctagatagaaattgtatcattgtatgctcagtgactagtatgtcacctgacataaataaggctcagtaaataattggtgaataaagatttaaaaatgtactttgctatcaattgtctcagacactggggtgggggtgggggaagaacaagacatacttaaccttgactttgatgcttctgaagaactttatagaacttatatttaacttgctacagatagcaagttgacttttcaagacatcataaaagacttgacttttcaagacatcataaaagactgtcataacagtctatataacaacatattttaggaagaaatggagataaaacctatttataatgctttgacaacactttgtgctttatgtttcatctttcttgagaagaagcaaactctcctaagtagttttcatttttaaacttcatgtttaaaaatttaaaaaagattttaaatctaaaattactatgctgcaaattctctaggattacaatgatctcagggagggaaacttagtactaaatatgattttaaatttatgtgtttgaccaagcaacacataaaatgtaacatatttatttatattaagcactatattcataatggaagctcaaatctaagacttgatataagacaatacccagcatttaaataaaacagtaattcagaatttagatatttataaaattttatagagtcatatagccaggtttttaatggaattattgatcatcagtatcacttttaatataattcatgatgtaaaatgagaaatattaagtacattttataactctgactatatatgcaaaataaagtgaataaatgaatcacttatctatagcaagttaaatatagttacagagttctggatacatatgaggtacataatatacaccatttgttgaaacagtgaatatatatataccctttcttatccaaataaagtccttaattctcttttctattttatatagacacaaacacacaacacacagtgttaatcatttattgacttgtttgtccctgcaaacaaaggaagtggtggtaatagtcccttaccataatcctacaacttatgtccatttaaatcacttccaaactttttttttttttttagatggggtctcactctgtcgcccaggctggagtgcaatggcatgatctcggctcactgcaacctccacccccgggttcaagtgattctcctgcctcagccccctgagtagctaggattacaggcgtgagccaccacacctggctaatttttgtatttttagtagagacagggtttcactatgttggccaggctgatctcaaactcctggcctcaagtgacccacccacctcagcctcccaaagtgctgggattacaggcgcgagccaccgcacccggccacaaactttgttttgcataagacattatttccaaacctattctgggtaacagttcaaataactcaaaaccaaaacagatttctaaggcaacaaaggtaacctcagacacattttctgtgtcactcatcaactcaaatctgtcatttgttccacttccagtgatttgccagttccctcaaaggcagatgtttcctgtcatctctcatgtctgtgtacctgtttatacccaactctgtgacactaccaatgtcctgcgtatgagaataactgtgttactttcacagccaacttgctgaattcctcttttaacaaataagaaatttcacttaatatttactcaggaaattacattttcttataacatttttgtgtgattcaaagtaggctctgtaactcactgtatctgtgtgtccgtaaaaatataaccacataactaatactttgttcattttatgtatataatccagttaaaatcccattcaaagctacaagacattatacctatttctgttctaccccaattatattagatttcttaagagctactatttcgaattttgttctagagcttactcccaaattttttcctatcagagcaatatagactgctatgggatatactaagctgggcaacattaggcacttaaatatcacaatttaaatgtcaaacacaattagaatgatctaggacaaaacattgatttctttgcagggtttgtgtttctccacattattttctcatgcctacaccgtgactagccctaggtggcccctcaaccaataataaacaaagatggaagtgatgctagccttcatgaagtcattggctagatagtaacttttgaagagtcgtaggtggttagggagacttaagctacactgcagcataaatgatcttataggtgcactaattctgtctttgcctccacttcctcctggcttcaacattgataatttactagtcatcattacttgtgttgtcaataaggaactaaaatggatttggcactgtgctactccaatcagtattatactttaccttggataaatttaaattttatatgtatgaagctaaagctgaatcaaattgtgatgatttggtcactaagattcagtaactgactactaaggtaatagaactgatgttttttagccgaactcatcataatcataggttctttaaacttctactagaaatagtgcatgtttatttctaagttcaaaaagactatactctttttaattgatgtcatattttaccctaaaatggctgcattttagaataaactcattatctgtgtaggattttcaagcacattaatttgtcttcttttattaatgataatagaaaaacccagtgctttaaaatacaatcatatgcaatttatgaacattatttcctataacacttatttaaaaccttgaaataaagtatttgccctgtaaatagctatttttattttattatattataaatgtgttttatttatggtgacatagaataaaactcttaaataattcaaatgtagaactttctggcaagcatgaggtatattttaaaatattttcaagtttcaccaaatttgtttatagttttctgtataaaatcaataaggtatatccacattactactctgtatccaatggtaagatgaaagtggtcaagctagcatgttcagcaaaagctatgcctagagttgagctcaataattcactaaacaactcattgctgtatctccattaccccaaaaaatgccttgagaaaggacctaatgctatttgttgtgcatcttcaaagtaactcagaattgttaaaaacttaaattttgaatataccaatttctgttatatactgtcatccaaagaatacttcaaatatgtggagccattcatctgaaaaaaatcctcaaaaaagtcagtgcataaaaatattatttggatttctgcttctggccaaaattgagtaacagagaccagatttgctctctcctgaagcaaccaataaaacagacaaaatacatgttacagtagttttgaaggcactggacatcagatcaggatgttttaagatattggaaaatggaaaagcaagcaagtcagttctatgcttttgttagcttatggcctggaacttccagactatgatgtagagaggaagtatctctgcagactccatgaatggatgagatgaagctgagtttaggaaaatcagggtggttgtatagttcacaaaacagggtaccacagaggagagagttgagcagagagagaactctagggatcttctcaggttccccttgagtactgagaagattattcaccaagcatgtgtcttagaaaactacctgaggctgaggataagagagaacaccacctggcaatcacactgtgccagaacagtgtctgttcctacactggcaaacacttcgttttaaatgcgcattgggtagagtattaggaagggtcttgattcactagtgaggaataattagtcttagaataaatggtatgctggtcctgcctaacaaattttcaaatgtttaaagatacaaaaggatcaaactgtgtaaacaacataactatgtcccgaaacaaagatcaataatttttatgggaatacaaaaatatccagcacttaaaaaaagtaaaattgacagtgtctggaattcaattgaagattgtcaggaacataaaactgcaggaatatgtgacccataataaagagaaaaattaatcaaaactgaccaagaagtgacacagatgttcaaattagcagacagggaacttaaacagttgttataactgtattgtgtatgttcacaatgttaattagagatatatgaaatataaaaaagacacagatcaagcttgcagaggtgaaaactacaatgtttcagatgacaaatacactggatgaaattagcggcagattaaatgttcaaaagaaaagataattgacttgaagacagcaatagaaatcattcaaattgcaattgacaaatggagtttaaaactcatatagagtctttgctattgtgaatagtgccgcaataaacatacgtgtgcatgtgtctttatagcagcatgatttatattcctttgagtatatatccagtaatgggatggctgggttaaatggtatttctagttctagatacctgaggaatcgccacactgtcttccacaatggttgaactagtttacagtcccaccaacagtgtaaaagtgttcttatttctccacatcctctccagcacctgttgtttcctgactttttaatgatcgccattctaactggtgggtgggggaggtgggaaggatagcattaggaggtatacctaatgtaaatgacgagttaatgggtgcagcacaccaacatggcacatgtatgcatatgtaacaaacctgcatgttgtgcacatgtaccctagaacttaaagtataataaaaaatatatatatatgaaacttagaaaaaaaactcatacagaactacaagggacataaaacagccaaaacagctttgaaaaaaaaaaaaaagaacaaaaagttggggacctgcactatgttatttcaagactcgtcataaaaggtacaggaattaagagagtgtggtactggtataaaaatgacaaataaactaaacagaatagagttcagaaatagacaaactcacctatggacaactaataattgacaaaagttcaaaggcaatgcagtggagaatgaatattttgtttttatgcagttggaataattagatactcattttaaaaaagtgaatctcaacatatcactcatatgttatacaaaaattaactaaaatgggttatttacctaaatataaagcataaaactaacttaagaagaaaatttagaagaaaatactcatggtgttgacttggcaaaaatttcttagatccaaaagaatgatttaaacaaaaaagctaagaaataatactctggataaactgcactttaaatatttgagaagcatatatgtgatataggacttacatcccaaagagtcaaagaatgctcaaaactcaataatatgaaatcaaacaacctaactaaaaaaaaaggaggggattaaagatttgaacaaccacttcataaaagaagctatacagatggaaaataagaacagaaaaaggtgctcaacattagtaattaggaaaatgaaaatcaaaacagaaatgagatacttattagaatggctaaaattaaaaagactggccataccaaatgttggcaaaaatattgagaaattataattctaactggcatgaatcagatttttactatatattcgtgagtcttcacctttcagtatatggatttttttttctgtcttttaatacagtactgtgtttccgtctcttctcctcaacacattaatgtcccattcactatacccctagctcacacagcctttaatattaataaaaatctcaagttggcatctaactttagataccttcctgatatcctgatgtgggctatagcaaacatttttttttttttttttttttgctacagaaatcccaaagaattgttaagcataggtatatataaagtctcttgtcaacctttaaaatcaattaacttcagaacaaaatctcaaatgtcataattaggggtgaatcactaataattggaaatatcagttttatttcttttctaaattaaataaaaaattaaattcctctcttaggttctatgagacaattccatagtaaaccttatctctaatgtattttctatccgctagctgatttctttatatacagtggctaaaaagtttgttagactctaacttcagaaacaagttcatatttgaatacttttttttctaatgacaatgcctatatataaaatgaaaaagcagttccaatctaccctctatagtataacactatttctacttagaaactaataataataatgataaatctttgcttttatcactcagtacctgagcttcttcctgttgctttttaagctgttcgagcatctgctgaaattcggcctctttttgttctgcttcttccaaggtggcctgattctgctcctcataggccatggccaccacagccaggatcaaattcaccaaataaaatgagcccaagaaaatgaccaggacaaaaaatatcatgtatgttttcccagcagcacgtaatgtctaggggaaatgggggataattccatcagtattttagtataatgtccccaaataaatatctgattaccacagttagatagtcagtagactaattagctttttagtatccagtttattttcaccaagaattttttggtattgatatgctcaacacacaaaattaagaatcagattatttgaggcttgactgcagtcttgttggatataaatacattttaaactcatatatagtggatatatatgtgagccccactataatgcttttattagagttcatatgcagagcaataatatgacaagtaagagcactgaacctttaaatcctttcagtgggattccatttgcactgcagctattctccataccatctatagatgacttttgctcccctccccttctagtctcagttaatagctagagctttaatttgaaattttcacatcaacatcactgatttttaaaatcttttaacgtgctgtttatataccaacaactggattatcaacttctaagagtcatgagcatctccaagttcctagcagaatgcctttcacataaaaaagtcctcagtgtacatatataggtactgactcagtgagcaattaggattcctggcacacttgctttatgttggaccttcctctgtgttccagagtgttataagcaggtcctttcccttcccttcccttccattcccttctctccctttccctttccctttccttttcccattccctttccctttccctttctttttttgagatggggtcttactctgtcatctaggctggagtgcaatgatatgatctcgactcactgcaacctccacctcctgggcttgggtgatcctcccacctcagactcccttgtagctagggctacagatgggcgccaccatgctgggctaatttttgtattttggtagagatggggttttgccatgttgttcaggctggtctcgaattcctggactcaagtgatccatccgcctctgcctcccaaagtgctagggttacaggcatgagccaccacacccagcctatgcttttcatttcatacatgtctataaaaataaatgttatgcatgctcatttggaccttaccaactggtaaagattttcccagtagtcttgagtcatgagtcgaaatagagacaggaaagcccagctaaaggtgtcaaagcttgtgtagccatagttggggtttcgaccagccttcacacagatgtatccttctggacactggctataagagagagaaatggaggtagggtcagtttagaaattacagcaatttcaatttatttgacttataggaattttcaaaacccaaagctgctatctgtgacgaattatcttgctttaatttccagaacactttaggtgattgcccaccgtgaaacttatcagatgaaattcactaggaagaccgatagaaaatttagatgcaaataaatatttacggacatttagaatggcagaaagctagcaaccacacacttttggctctgacattaccatatttctactctttacaaagtggcaagaatcaatagttaaaaattaaggccgggtgcagtggctcacgcctgtaatcccagcactttgggaggccaaggcgggcggatcataaggtcaggagatcgagactatcctggctaacacagtgaaactccatctctactaaaaatacaaaaaaaaaacaattagctgggcgttgtggtgggtgcctgtagtcccagctactcgggaggctgaggcaggagaatggcgtgaacccgggaggtggagcttgcagtgagccgatattgtgccattgcactccagcctgggtgacagagcgagactctgactcaaaaaaaaaaaaaaaaaaaaaaaaaaaaaaaaaaaaaaaaattaaaagccagaaaacagacaaagagtggggaatcaaccatttcattagctggttttgtagaattttctaaaataaagttaatatttataacaattttttatttacagaaaaagtatgaggatagtacaggcttcatacattccatgccattttcaatattgatatattgttattatttaattgagatgggatcttgctacgctgcccaggctggtctgaaacttctgggctcaagcaatctcctgccttggcctcctgaagtactgggattacaggtgcgagccaccgcacccagccttaatacattattattacctaaagttactattttattcagatttcatcagtttttttctttttttttgttttgttttgagatgtagtctcgttctgtcgcccaagctggagtgcagtggtgcaatctcggctcaatgcaagctccgcctcccaggttcacaccattctcctgcctcagcctcccaaatagctgggactacaggtgcctgccatcacgcccagctaattttttgtatttttagtggagacagggtttcacagtgttagccaggatggtctccatctcctgacctcgtgatccgcctgcctcggcctcccaaagtgctgggattacaggcgagagccaccgtgcccagccctcagtttttttcttaatgtcctttttttgttccaggatcccattcaggatacacatcgcatttagtagttatgtctttttaggctcctcttggctgtgacaatctctcagacttcccttgtttttgatgaccacaacagttttgaggattactggtcagatattttatagaatacccttcaattgggatttgtctaatgtttgtctcatgattatatttaggttatggatttttgggtggaagactacagaggtaaaatgtcactgtcatcacatcacatcatgccaagggtacatacttatcactcactatgacttatcactcttgatgttaactttcaccacctgtcttgaggtagtgttaggtttctctactgtaaatttactcccttttcttccttttccatatgtgctctttgaaataaagtcactgtgtacagaccacatttaaggaacccgcagttatgatcttaagtatataccaaaattatttgaaattattctgcataggatatttgtccattcatattttatttaattattcaatcatttcaattaacatgtagtcatggatagtcattttatattttggattacaattcaatgatatttcatttatttgttcaaatggcttcatctttggccactggaagctctttcagttgacacctgtaacagtttgacatacaccatggttgtgggttgcatttttttttgttttttaacactttcttagttttaggtactatcagatgctccaggctcatcttttataatttctgccgcagtcctagaatcaaccatttctccaaggagccctagttctttttattggaaaatggtattagaaaccaagatctgagtgctagctgtgtttgttgctactggggtgtcattgcttctaggccctctcagctgacagaacaaggagatacacatgtttgtaattgctcagtactggtacacatgcacagtggtttcaggattgttaatctatactaccattggaaacaactttatcaactagggtattgttccttttacctttagtcttacagactccactcatttccaaagttacttaggttagcatgttattaccccaccacctacagtgaggtcatttcatattttgcaatacatgtatatatttttgtcacatattccatttcttcctgggatccccaaacctcacaaaagattttttttttaatttgtatatattaagattcactctttgtgttataaaggtctatgagttttaacaaatgcattaagtttcatattcaccattatagaatcttagagaacaggttctcaccctaaaaaaaaatcccctttgctttacctagataatccctcaccatgaacccctggaaaacactattttcttatcatctctgttgctttgtgttttctagaatgtcaggtaattgaaatcatacagtatgtagctttttgaggttggctttttctcacttagaaatgtgcatttaatattcattaatatttgtttgtatcttgatagctcatttctttttaatcactcagtaatattttattgtatgggcataacaatttatttatctatacaactattgaaggacatcttggttgcttccagtttggggtcattgaagggcatcttggttacttccagtttggggtcattatgaatacagctgctataaatattcacatgcaggttttttgtgaagacataagttttcaaattgatcagctaaatacctagaagtgcagttgttggatcatatggtaagactatgtttattttgtaagaaaccgccaaactgtcttccaaggcggttgtctagttttgcattcccaccagcaataagcaagagttcctgttattctgcatcctcatcagaagttggtattgccagatacatttttcagtcattctaacagatgtgcagtggtaactccttgttgttttagtttgcaattccctaatgacaaatgatgtcgagtgcctttttacctccttaataaccacctgtactatatactcgtgtggggtatctgttcagatcttttgccagttttaaattgggtcatttgttttcttattgttgagttttaagagttctttagatattctggacactggtttgttgttttgttttgttttgttttcttttgagacagggtataattctgttgcccaggctatagtgcagtggtctgatcatggctcactgcagcctcgacctcccaggctcaagtaatccttctgcctcagcctcctgagtagctggtaccacagatacactacaccatgcctggctaatttttttatttttattttttggagaaacagtgtctccctatgctgcccaggccagtctcaaactcttgggctcaaatgatcttcccctctcagcttcccaaagtgctggattacaggaatgagctacttcacctagccccagtctttttttttttttttttaaatcagatatgtgctttgcaaatattgtcttccagttgctggtttgtcttttcattctcttaagaatatctttgtaaaacagcagcttttaattttaataaaatacaaatcatttatttctttaatggaatgtgccgcttaaatacaaaatggttttgtatttaaaactcatcacctggctcactcctgtaatcccagcactttgggaggccgaggcgggcggatcacgaggtcaggagattgagaccatcctggctaacatggtgaaacctggtatctattaagaatacaaaattagccgggcgtggtggcgggcgcctgtggtcccagctactcgggaggctgaggcaggagaatagcttgaacccgggaggcggaacttgcagtgagccgagatcgcgccactgcactccagcctgggcgacagagctaaactccgtctcaaaaaaaaacaaaaacaaaaacaaaaatctcatcaccaatggccaggcgcagtggctcatgcctgtaatccccagcactttgggaggccgaggcaggtgaatcatttgagatcaggctcccactgattctacattatggtgacttgtacaattatttcattatatattacagtatgctaataatataaataatgtacacaataaatgtaacgtgcttgaatcatcctgaaatcatttcccaccaccacccttggtcggtggaaaaattgtcttccacaaaacagtccctggtgccaaaaaggctggggactgttgatgtaaattacttaagccataataggaattcattaaggggaatagattattatggtttaataggaataaagtatgtattaaccaaatttatccaaaattttatctgggcttttatgttaatcatcatcataataaataatagttaataggcaataaattcttttctttttttagagtgtgctttttttttaaatttattaaaaaaattttttggggggacagggtctcgctttgtcatccaggctggagtgtagtggtgccatctcagctcactgctacctccatctttcacgtttaagagattattgtgcctcagcctccagagtagctgagatacaggtgtgccccaccacacccagctaatttttgcattttgtagtagagacaaggtttcgccatgttggccaggctggtctagatctcctggcctcaagtaatccccctgcctctgcttcccaaagtgctgggattacaggtgtgagccaccgctcccagccatttttcagagacagcctatcacctaggctggagtgcagtggcatgatcatagctcactgtggcttggaattcctaggctcaagcaatccttctactttagccccctgagaagttaggactacacgtgtgcatcacaatgcctggctaagtttttctttttttcttcttcttttcttttcttttttttctttctttctttttttttttttttttttttttttgttttgtagaggtagggtcttgctttgttgcttaggctggtacatacaataaattcttacaattgtccatgtgatagttcaaatactttatgtgtattaaatcattaatcatcacaactattaaagggacagaatattactctctccattttaacgatgagtaaactaaggtacagagagcttaggacacttttccaaggtcaaagagcttacaagtggtgaagttaggatttgaaccctggtatacatgaactctacaacctatgctcttaccccctacattcataataaggctaggaaaactgtcaggaaaaaaaattccccaaagctctatttatatgactagtatacattttcattaactctcttagatttttatggctacaccagtttccctttttaaaggatgactcaaaatatatttaagttccgtgtcctaagagtcacttactattgctatctctcagctcttaaaaaattccctattttgatttaaaattaacttacaatactcttaggaaaatatttaagggttagagaataacagcatgactaagatattatggcatcttttgttgtaacgtgtggcctaaaagaactattcattatgtcaactgatacttggacatgcctttggcacacatgcacccttggcttctttgtatacagaaatacatgctccttcaagaatacttaaatatttcaaagcacttccccaagtgtgcttccaccctgaagaccacattatagtctgggtcttttccagtcacgacaaaactcatcccattgatacatatgtacaccaataaaaaggggcccatcttgtgttcctgtgtttcctaacagctctgatagatgtacagcaaagacagactctgggccttcacacattggagcatcaatttaagaacatcttaactgtgaaattttggggaaaggtcttcacaaagggataatttttaattgctgtgagtttaggaccagtggcaatccggtaaggcagacaaggcacttcctaggggagcagcactgctctttattgcatacatggtaaggctacacatataaccatgtagttgttttcctacctacttttttttttcgcaaagagttctatatcttaaaaaatatattatgtttcttaccctgcatctgagccatttccacagagtaaagggtctttttgcccatccaaaacataaaagtgacctgttaatacaaaaaaaaacccattttatttcatattaatcctattcacattagtattagtaataaatcagagttggactatttcagttatttacaaaggtggctgtacacccacagtctcaactatttatagttgaaaattcattcagcaacactaaggttaacataatgtaatacttcttactgtcatctccaatgtaatccttccagttaaatgtgctcattgttacattaacaaatgtcccatttgaatccattgtgccattaaagtaggaagtggtgttggtttcaaaagcagaatcgcttgggggccactgcaaacatttattcctcagattgcccatgaacagctgcagcccaatgagagcaaacacgctcagacagaacacagtcaggatcatcacatcagaaagcttctttaccgactggatcagggcccccacaatggtctttaaacctgcagagagagaactataggttacctgaggaagagtgccagaaatcatgatttcttaatagtcacacacattctctttcccccataaatgattgcttgactatttagacaccaaagctgtatggatagcctgatgatttgggaaatagatgaacagcagattttacacatgaacagtgtgcttgctggaaattcaatatgaaggtttaaatatctagtcaggaagttttgtttgtgtggttttacatgctgaacaaacatacaaaaaaacttggagttatttttcatttcagattttgtgtttcatgcagccattttccaccaatccattctttactctagcctccaagcagtagtaatttagaggagaaaagaattttaaaataatgtaagtctcatgtctcatgccatatacatgctcttcaacaataatattttctcctttgtaaaaggagatccatttttgaactacatctgcagcgaatggtaaaatccaaatctgttagtaaagccatggtagtgaaaaagagagagagagagcgcaagaggcccaaattagcattttttgaagatgtctcatgcaattttctgttaaactcaaaggctgactttataaatacgcatgtaatttataaaattttaggagctaaactgacattgaaacatcatttggcattatttaacgggatgaactgtaataataagcaacaaggctaatgctgtaagtcatataaattgatttcaaactcaataattaaagtcaacctcggtgtttaacctagctctcacctggaatgactgaaattgttttcagtgctcggagaactctgaatgttctcaacgctgagacattgcccaggtccacaaactctgtcacatatctgtaataggggagttcacacacaaacacaataacacacaagaaaagttggagatataaggggcctactaccttacaccagtttcttcttacctggaattacagaaatagttttcagagctctcaagactctgaaagttcgaagggctgaaacattgcctaggcttacaaattctgttacatacctgcagaattaaatcagagttactgatagttttggcaaagtttatactaaataaggacttaatgctgggtttggcacatagagccctgtgagtttaacaaatggaattgctatagacctcaggctgccatatgctaaaggttgcttttaagaaacaaaatcgtgttgctttatttcaatgtaattttcactaatatgaacacatttgtttgcaaaactaatccaagtacagttgttgctattaaattgtagtcaatgaataacttcattttgatgaagagaaagactatatgacatgaagataaccccatttattgatcatttactggatatatttacattgcaatatgtattctaatatgtattcttaaaatacacaatccatatagttaacttgactaacaagaaagctctacatttaatatatgacacaaagaccttgtttgtactatgactattttcactcctttgcgcttatcaaattttcaaagttactcacgccatcacaatgacactgaaatccagccagttccatggatcacgaagaaacgtaaaatcttctaagcaaaaccctcttgccaagatttttataagtgactcaaaggtatagattccagtgaatgtgtacctaggaaaaacatccaagccaaaattaacaattttgcttgaactgttaaaataaatgttttcaatcatagcaaatcctatccttttgtggtttttcaattcattaaaatattgttccttacttctatttaccaaataatctattcatttagttagttttacaagcctgagcaaagagttaaactgaagagaaaatatattctttaggaatctaatctggtttaactatttgggttttagaataatagtttcatgtatcttatggataatcatctagtttgaccttctagcgcagcagtatctgatagaaatgtaatggaagccacaaatgtaattttcaaattcctagtagcaagcgaaaagatgagaagaagcaagtcaacgtattttttatactgcattttatttaaaccaatatatctaaaatatgaaaattcaacaattaatattagccaaatttcaaggttccatagccatatgtggctagtggcttcctcatcagacagtacaactttagaggcaacatagcttggattcatttacttaaataataaaatattttattcaaatttcttaatgagtagactcattttgagggctagtttacatgtctaccatagaaaatatatttcttttttttcaatttttaagaatcatgtagagttataaactgccccccatttctctctcttctttctctctctctgccctccttcctcccaccctgagtgtatgtgtgtgtgtgtgcatgagcatgctgtatagagatgtgtgtgtgtgtgtatatattatcatatgaaatgttccagttcactagtattttatatgtgtgtgtttgcacaaatgccaaaatacacggatacacaaaattcttaaatcaaaccttgcatcagctactatctctatgcaattgggctaaatcattcaaaccttgcttaaattcaattttcagcctccaaaatggtggaagacttttctatttgctgtttaatgtcatgtatttctagccctcttttctttgagtcttgacaatataagttattgctgttttcgtttttttcccaaaatagttgagagtacttgtttttcaacattgtgttctttaaaagcacaatttaagtttatttttcagagcacttcacccaagccacaaagatttgatttactcatattaaattcattagatttttcagcctaccagtatttatatatgaaaaatgttaggatcattattttgaaatgttttctgcacaagtttctttcatatgagggaacaaagacatcaagaataatttatgcagatatcttcaagtctagttttcttaagtacattcccttccttttctcccccaacaattcaattgatctcataagcaataattcctatctttacttatatgaagtagctgactattaggaagagatatattttacaatatcaagcttatgtttactgtgttgtagtttggatcgttgtgtgacacacataatcaccgtgatatttctgtctgtagagatagctggccttttaaaggcctagaaacaccacacatgtatgttctgtttcttgtattagtggttagtgccctgtggtttatgctgaggcaattctgtcttatctatagagttactaggaataagattaaagtccctacttttgttcttgatttggggaaattaagaaaatatgtgggtacatttggaatgtatgggaagtgttcatggctgtccatggaagagagtcctagagcctactgagacagagctctacacagaataggtattcaaaaatggttattagtaactaggttgggcaggtaagtgggagtcaggggacctttatctttcgtggctatgcccacactaggctcataatcaagctgtcaattctgtctatgttcctgtaactttggtgttttaaaaccttgaaatttggctaatcttaattgttgaattttcatattttaagtatattggtttaaataaaatgcagtataaataaaattaaataaaatgcagtctatagaagtgccttgccttatataacattcccctcactatataatatggttttgtgtatgccacatctttgtacagggactgtttcaaatatcggtgacttcagttttcatctcagaactaagttatcttctgtttcactgaacccagggtttggggtagtaaccactactactttgcttttttcctgctggcttgctttcaagctactgaagacaattgatcagaaaacctgagcaaagttttccagctgaatgatgcaaatcaaaaactttctaaagctaagactgccttcataatgggtataatcatctctaagttattactgcttctttagaaagagaggcctgtatattcaattgccttttttttttgttttgaaacagagtttcgctctgtcgtccaggctggaatgcagtggtgggatcttggctcactgcaacctccacctcctgggttcaagcgattctcttgtctcagcctcctgagtagctgggactacaggtgcttgccaccacacctggctcattgtttgtatttttagtagagatggggtttcaccatgttggccaggctggtcacaaactccaactgccttctttaactatcttttaataatgttatacaaataaatgaaattgatacatgtttaaatgcttcaataatttctgctgggaaaaccacatacagagtagtcttacataggagtgtccattttgttaactccaaaatcatgtatagtaaatgagagttctaagttaaatggctttcctcaatatgggagctggattctctattacaataatttctaggcagcattttgaagctactatttttttttaaataacatgttaaataactgacaaataatggcttagagtggtacagtaaatcctcagagaaatctataaaaacggaactaaaagtggcagtatttgttacactatcttatctccgattgtacattacttttaaaaatataacaataaaaagagcatactgcattttttacttaaccagtcagatacctgattattgtattatactatatataagtagcctatataaccactttgtttcactaaaaactatgtttctttgatgcaaataacctcatatgtgactgaaaaataagaaaatgaaataatgttgttacgataaagaaattgtgttagttcatgcacagttttccccagcatattgatgttttgaaacaatgaagggcattttttctcacacttaaatggaaaatcccttgcaataataataataaaaagatcttgatactaatacacaacatccacagaagtgttttcttttagtgcaacaagggcctggtttaacatcctgaacaactaatgtgcttagacctttctccatgtattaaaatacagaatgaagcattttattttgatgaaatcatacaaatatccccagtctccatttcaagggagaaaggatgaggcctgggatatgaggccacaaagaactcaatggctatgattttaggtacaaacattagaaaagaatcaactgggcaagtgtctttttattgggattattatggtttctatgttgtattctagttacaaagttccataagttttactctcccccaatcatgtttcccctaagccctgttattttatgaacacagttttatggaagacattttatttcttttacagaacacatctaagctgtttcagcacacatgttgtgtataaaaaacttacatatctaaatataacttagacatcttagatgtataattaagacatctacttaatttagagctaaaaacctaaatctattctattcgaatataacaataatcactatatactggaataaaataatttaattcatcaaattactgaactgatcactgtattttatctcaaatgattaaccatgattgagacctaattttaggctaggtgattggtttagtttaccagaaagcatatactaatttataacctctctttaacagatattgtcatgattttgttggaaaaatacttacctcgtagaagaatagctcccccaaagaacttcccttatcttctttcatattatgaaaataactttttcttagacagaagtggaaaccataagtcaggctatacccacaaggagattgctagagaatttgagtgtgcatttctcattcccagaagttattcctacttactctacattctttgtccagtcaggagggttgctcaaggtcataaatacacagttggtcaaaatagtgcacatgataagcatgctgaataaagtagattatagttaaggaataaatgttagtaggttaccatggccatttataaatgatccaaaacacacaaaaaagtttatcgatgcaaaaactgtgaaattaatattatttgttttaaaacaatgataaaataataagaaacttcaaagcctgtgatatggccttggtgcactctttttttcattttataccatatactcacaaaactgaatttaatagaaaaatgatctctatttgaagcaaatgcaagttattttgcattccaatcagttgtgtgaaattgccctggaagaagaactcaccatcccttagtaagtttatagtatgccataagtgtaaaaggtgtacttcagatatattcatcctcactgacttataaaacgttaacgaatgcaatgtaaaaagtgtgagaatgtagagcccagtataatcaaagattacattgattgagaattctatcataaatagtaggtttgtagtgatgtaacttactcctttacaatttatagcataaaagagggagatccaattttgtgctgataaggtaatgttattttctagctttttatttacactttagattgtggcggaccccaacagaccatctggctatactcttgtatctagtccacattatacctaaacagatagcactattctgatgctcttctgagaattagctgtagtacgttctcttgggatctaagtccagacttccctgtaagaaagtttatgattattttgagataaatattttattttagaatataaatactttccaacatcaagccatagaatgagagaattcatacctcaaaaggttatcagtttcatttgccctgtctctaggtgaatcagtctttaagtttatatagaagcctgctttgaatctgcctatacaaaattcccattcttgaacactgcctcagaaaatcaccattctattttatcattacttgagaattttcttgaaatccaaacatattctgcccttttacatatgctttttgactaacattgtaaataatttcaagttcgactttttgatacatattctcaaccaggtacatgagcacatagtaagagtctgataaatatttactgaaaaaaagaagggaataagacggaagggaaaagggaagaatgaaggaagggaagaagacaggaaggacagaaagaaggaaggaaggacacaaagaaggataaatccaggcgctgaagatacagaaacaattaaggcgtaaaagtttgaacacttggtaatgcaaatagtaatactaaccataatctaatctttagcaatggttatatatgacctcattgaagctgataaaggtgtaaggagatttgctctttttcctactatgtgtttcctttgcacattcactatcatggttggttacatattttcttctataatgctgtagtcattctataatactctcattataaatagtggaaaaccaatgcaaataaatgaattaaactaacaatgttaccattaatctcaaagaaattttacagatacttgaaaatataactgacattttctttaaaatcaactgttagaaatagcatttaggcaattcacattaaaaggatatgaatgtaccaaaatcttgatagcaattttcctaacagggtttagtggagttaaaatatacaaggcagaggtggcactgaatcggaaaattgcctttcctttattcattactataaaagtctgaaaaagaaaatacgagtaaaattactaaattagacatgggcttatttaaagagcttacatacatgaagaactttttaaaaaatagaatttgtttgttcaaacttgtttgtttaaaccagttgatatatcataactacaaacatgttagatgtttaaattaacatatagttacaaataaagatactatttactattacctaatctatctctaaggttccaacttgctgatacaaactgacaattctacacaaatttttttatggaattgtagcgttacagattccaactctatttaaagcttaccatctgtcttcagctttggtaacttttcagattactctgtacacattgctactaaaataatcttttataagtattttaatcatatcaaatcttttaacttcaaagtttatgatggcttctgattgtccctgtagatttaaaatgttcaaacaggttgaataatctggttttgctgactatagatgtgtgagaagggttcaacttctcagctaatactgaagagagatggatgcattgaaatttagtctgaaatacaccatttcaaagggcattccacaattaaaattctatgatctgaaagctacaatcatccacttagtattagctatgctacaagtgattatttaccatgttcctatagaatcatcttttatttttttcccactagagtcatctttgctatggccaattcaattcagttgtcagcctcactcacaactagtcaaactctccctatgactctgaatatgaatgtcatagactcctagaagaaggtggcaactgaaaggtcatttaatgcaaactcccttcatttcagggaaatgtctccacaacacattacaatatagttccacctacagtgaccccctattatgtcagaggttcttaatcctgcctgaatattaggctgtcctgtaaagattttaaaattgccaattgaatgaaaatttctgagggatgggcacagatttgggtatttttaaaactttcctgaggcgattccaatatgcaatcaaggttgaaaatcccttctgtctgggaattttctcagctatcaatcacctccttaatcatgtccttccaaataaatcacactacctcctgatcactccctaattgtttctctttaccagtaagtcttagtacattaatttgtactcttttacatgttgcttgtaattatagtcaagtagcaatttacacagtgttcattccagtgagaactaggttagaaattgttataaaccattgagcataaagagcttgtaatctactttttctccatttttttcacagtatttaatagcctggtttgcaaataaacacttgttttaattaaatgtgggtttaccttaaagatactatttacctttaagacatctattctgtatatccatttacttaataatatgtttctctcctttaactaggggctatatgccatacatttatgttcactgacaacatgctttgtttgagtaggtagacaaaaatatttatattgtcagtataaagggcagggaaaacaatttctctgttcattgctcttttgtatttaagaccatggtgccaaccattacttaactaaccattttccagaaactgaacagtttttctgttcattatccctttgtgtttaagaccatcaagccaaccattatttaactaaccatttttcagaaactacacagtttctctgttcattgcctttttgtatttaagaccatagagccaaccattacttaactaacaattttccagaaactgcacactataaatgtgaatagttttatgaagcgggcaagcaaactattctttactagcagtaggactgtgtgtaaaggacagtggaccttggaaagactgttgttgaagcacagaagcattaaagggttgccttggagtcacaagattagattatttaatattacagttgaacagtcaagatccatttaggcattcagcaacacaacagcataacttgaaaaagctcaccgtaatttaaggttcaggtactcatgctcttttgaaacaatttccctgaaaaagcaatttctgcttgcgacattaggagagagtttcattttgaactatctccaaaaacagagtgaacagcaataaattatccctttgaacatggaaccctttgctcctcctgcaagattagccttcgtagtactagcggaattacagctgacatgctaagagcatcttcgttgaatttataggttctaaaacagagcaggccttaagactacaatcccagtttatgtctcaggaacaatacctgacacaaagagaaccctgagttctgagaaatgcagaataaaatactaatgtcctgcatagtgaaagaattgcaagaatttgaaattatggggctctgatgatatgaagagatatacctaaactgaaaattacttgagaaaatgacagatgaataggggagagatagatcgtcattgctacagctggaagtatgttaaaccagctattttgtactctggaatgttacttgcttctttttcctagaatgttacttagatgcacatcttataagtttactaaaagttttactactttgtggcaagaataagatttacatctcaatgattaggaccacatcaatcagagaactcaaaaaatgatgcagccaattttttaactttcccttttattttattatgttaataagcatagtatataatttcacttagtggttaagagctctggctctggagtcgaatgcctggactcagatcctggattcaccacttaaggagtgtggccttgagcaagttacctcatctctctgtgcttcacttccccatttacaaactgagctaacaataggacctgcctcactggttcactatatagtaaatgagttcaagaacttagcagtgcttgacacagtatgagcacaagaaaagttagttatgattatcactgtcactattattaatagcaccctggtcaaattaaatgccattaaaatacattgtgatattactcatttaattaaattaggtattcaaaatgtatcactaattaatgatggtaaagagttacataatgctttaaagcttttaaatgccttttacttgtatttttccatataattaacacagcttcataacatatttttaaattctaaaacttcctccattagcttcttactttactccttctatgctaagaatgacaaattacctccttgtttaatagcacctcaatcttcatctttatggatacttcataaacgaaagcagtgcagccaaccgtaaagactatctagatgtctcgcaagatggttcacagccactatgaataaatcagggtctaagtctggctctcagccatggaggcaataaaaattgactttgtcaaaaacagaggacaattctgttttttagtggcagactcacattaaccaaacttgaaaacctgatatataaaataagaatgccaacctatttatttatttagacaggacctcgatctgtcacctaggctagagtgcagtagcacaatcatagctcactgcagcctcaaactcctgacctcaagcaatcctcctgccttggcctctcgaagccctaggattacaggtgtgggccatcatgcctggcctccagtgtatttatttacaatgagatacattactttcatatggactgagataattgtagtgatgtaatgagcacgttcttttcttcaagcaggtttaggggaaaacaaattgtagtcagaaggtttcttgctgaatatggagcccaagccagctgacctaatcaaatgatgtggaatgtttaatagcatgtgttaggtagttcagtgtagcccctccacaatgaggtggcctggccattgggaagaaaatgctttcagtgctactactaaagttctgtctcccttggaaaatagtaacgtttgcctctgttgttctccttttgtttcccccttaatcttaccagcctgattgattctcttttttaaggacacttcctttctttaagtagcaaatacttttaatcatagcagagtaaatcatgcctcctttcttaaagatatctttacaaacatatccttcagagcaacagttttcaccggataatattttgtccaatttcttggggggtgacttattgtaatcatcataactacatttcaaatttttctttatcaattctatagtaaattgttgaaataagttatttttagaagtacatgaatgtattaaatgtcaccttttatgaaactagctataaaaggggaaaaaggagactctgtttagctatttacatgtagtcttatgactttaaataaaacattaaagcttgctattcaaagtgtggccatgtaacagcctgatgatttgtaagaaattcaggatctctggccctagcccagacctatggattcagaatctgcaaattaaaacatcttgaggtaatctgtatggatgtgcaagtttgagaagtacttatttagaacaacaggactaattccatgtctgaatggttgtcattgcctttagccatcattgattttataaattataaacttttaaaaggatgtgctttgactaataaaggtgtttaatatcttccataatctataagtcatcaactcatggtgatactaatttatctttagtttctacattgagctatttttacgcttttaagtgtaaaatataaatcgtggttataaaatgccttaatatccaattagaaagcatagagtataccacctattttttatattttctataaaatatcacccagctagtttaactatagaaaccagctaattctgatacaattatgcatttattttagcattaggaaagcacagtcataaccactaatttaaatcatgtatggatggagaaaatttgaaagttctttctttttggtcttccaattttgacatttttttcttcagggtgatgttttaatggtatacatgatccagaatctagcatgccacaaactatataaggttaagagaagatcctaatcatattctaggttactgggggggaaaggaatctctgggtgaacatgcttcttcatgtattgtctggctacaggaggatgctaagcagattatttattgtcctctagaatataaattattgtgaaggtacatcaagtcagtcatgaactaaaaaataattaagtacaacatatgctcataattcttttctgcacaggtattattctgtagtctaccctgtgcttgaatatgtcagccataacagatatttcactttgttgatattaattttaattttgactatctgaattatcactgtgaaattgtagaaatcattcatctattcatatttcctgactgtaaccaactcttgacttcatttcttataaatgtttgttttattatattgtgataaaaataagtgacagtgaagagtattataaaatctttaacagaagaaaaattgtgatgctgtatataaggcccagaaaagtatattacagttaagagtttcattaaagatttattagaagtctaaaatcaatactcactttcttattgatatagtagggatccaggtcctccaggggctctgacaccatctctggaggaatgtctccataaataaatggaaggttctttccagcttccaagtcactatttggctttggtttgttctcatcatcattatcttgttcctttttgggcttcttggctttctcttctgcagcacgtttttcgatagcagcaagagattctctagtaaaaaggcggaagctttcaggtcctgggggtaccaacagtgcctgtgccatcttttcatcctgcacatttaattacgtgtagcttcttgcatacgaattacctgcaataaaagaaaaattgcacaagagttaggaaagcaagcgattgggcataagaacatcaaccaaaatgtcattttttagtaactttttaaagctataaacattaagtcatgcttttagtactgcactacacatttgaacttgaaaacatcatcattcaacctcattctcaataagccaagttcataaatctatcaaaagtctgtacttaatgttaattagtttgatttagccattctacaatgtacagtatatataatatataaacattatattttacctcaagaatatctataattttgtccattttttaaaagcatttaaaaaaattctgttttgacactgtaagccaaaatatagtatactttcagcaaaagagtaatgccagtaaagtttgtcaataaaattgcttaattattctgcatcctgccccccgccttttcataactttgtaactccccaaataaagaagtactggtaacaatacaattattgtaatacatccctgactcatacaaatgaggatagaaaatgaagttttgccaaacccaaccactgttctcgttgtcagcatcattgacaactgctgctccagaaaagatctgatcaccaaccagcagggacatggaagccactgctgccagaaaaatctacctatctttagtatttcctttcttttattaagccagactctgtttccttctgaggcaatggagaatatgtttactccttatttcaatatgctgcccttcaattattccaagacaattttgacgttttccctgaatcttccatttagtatagtggttaaaagcatggactcaggtgctacactgtccgttctaaaccctggctctgccgcttatgagctgtgtgattgtggacaaagtaaccccttattgcttgaattcatctataaaatgagggtagtagggaaactgacttcctgggttatcataaggaataaatgagttgattatgttgtgtctagaatagtttttggaattagtaagcactatattattgtaaactatcataattaaattatcttcagtttccctagctattttccctcttttatggtttcaggcatcctcacaattcaaaccactctttaaacaagttcttgctgtgctggaaccacaattgtgactacggaattaaaggaatgaactgagaagtgcagtgtatagaggcacactcacacatgccgatcacctggatgagaaagaagggaaggcagactgatggagtggccctgctcaatttctcagggaagggaacaaaaatctatttgcaggatacataatagaactatcaaaaccacaagaaatcagctatgtaaatttcgaaatatgagttattttattttgcattatgccaaaaatcacatttaaaaaatcaagatagatagaatatagaaacaatgacaaaccaaataaaataagtacatcagtcatcttataaaagaacctaccactatggcaccaaagtcatgatcaaagtcatctgtgacattttccccattcctaccattcccctttgcccccacatgtattctaggctccgtagtagtttatccctaaatggccctctgattcttggcagctcactacatatatttgagcttacaatcagaagctctggatctattaataacataagaaaaacaatatagcttattatgtgtgtgggggtttttttgcttatatcttaattactagttccctgatctattccaatgacaaaaaagtgtttctataacattacttattatattataatattattatttttttgagacagggtctcactctgtcacccaggctggagtgcagtggcacaatcacggctcactgcagccttgaactcccgggctcaggtgatcctcccacctcagcctcctgagtagctaggactacaagtgccctccaccatgcctggatcatttttgtatctttgtagagatgaggtttcagtcgccattttgcccaggctgatctcaaacgcttgggctcaagccatccgcccgcctcggcctcccaaagtgctaggattacagcggtgagccaatgcactgggcccaaaaagtgtttttaacgtaagatatgtcttttctttgagttagtatttatgatataacattgtcattatatcttttgctactatgaaggtatattctatataagttataaaataaaatagcaggcctgtcaaaagttatgttatttttctctactaattttgaacagaacttctgttttatagttgggcagcacatttttttttctccatcaggttgtatagtacatgaatcgaaaggtttgagaaaaattctgttttactcaaaagtcagttgatcatttattttgtgttttctaaatttacgggaggcagcacaaaataaaactaatgtttttagccatcttatgtcaattttgatgatcacatcatcaatccaactctaagctgtgtggaataatcacagcttttatgcttttgagtgcagaaagagtttgagcattttctgcaagccgtaagtacctaaagatgtgtaatccatctgtctgatatcacctgccatgaactgaatggctgtggctcttctccagtgctgaatgaaaatgaaacagcatgacaaacatgtcttaaggaaattctatgaaacacggtcgctttcttagaggagaaaaaaaaaaaggttgatttgaggatttggttttgaactaattttgatgtctttattgacaatgaatgaaaaacacactgcaattgaaatgggagatctgggttagtattgagtctgctgctaatggtatgcctgtatcatctaacctgtctcagcctcagtatcattgaggcacctcaacacagaaatggctgcccttttccagatgggaatagctaatttatattaatacatacattttacttaattggattctcctggttggtttttgttttagaaataacattaggtttaaaatatctaatgtggaaatcaccgagtaattttcacaaattattctgatttatctgagatgatatggaacaaggtgccatcacaaaatcatgaaaaactttttacaaataaatagtcctttaccttcttatttacttatcaagggctggaataaagaatttgaatcttggtcaaaagaaagtaaaaacgtctcgttgaaattcccatactgttgtctctaagtcctcggaagataggctagttccagactctcagcttttcccctgcaagagaattagggtttgcccaatatttgggtaggctgagaaattaaagaatttagtgagtagagtttctcatggcttcaatgacaattttgctgtttggaaatccctcatagttctttcgcagttctcttttacttttttcctctcctttcttgtactctgtgagcttattatacagagttcttacataattttatattcacattagagcagactttaaaaattaattcttactgatgccttggtgtggaatatatatattattaatgattatatgcacattataatttattaaaatacataaaatttaatatatcaaattttctacagagctatctttgcaaggacaaaaaagatacgaaaaaaatcttaggagatgatctctttaactaaaaaccaaaaagcctgtggatgaatgtgtgtaggtaaagcaaatacatccctttgttaactagtaaaaagattatggttcagtatatcatatttgaggaataaactgcggaactccaaatctggaaaggatctcgaaatcatttatttggaaaatatttatggagggattctacgaatcagtactctgtttgaaccaggaacccatggtcacttccctggggctgagagtccaatgtgggaggcagatttttatacagataattataacacagttatatatggctggttattgtctgaagttcataaaaagtatcaatatgttcatcccagggaagggagagagaggtatggtttggagaaatttccctgaggaagtgatattggagtaggttttgtaggctagttggaatttgattggggtcttatggtggtagtggttgggaaaggattggtaggaagacacatcagtagagacacattgagcaggtggggtgggggtggcatgtgtgcagatgcagagacaagaaagagcatggagagtttgggagcaatgacaagcaattcattatgggtggacatcaccctgcacagaagggagtggtatgacataaaactctaaagttaggcaggatagatcactgaggaccctgtactacacacgaaagtatgccatggatggggagtgttatgatcaatgtgaagattggaaagatggtggcagtatgaagcgtggacaggcagggagtgatcctagagcagtagttttcaaatgttgtggtttcaggatttctttacactcttaaaatcattcatgaacccaaagaacttttgtttatcgggggacttagctatccatacttaccatattaaaaattaaaatgaaaaaatgtaaaaattcttattaactaataataagcacttgtatgtttatacagacaatagatggttaatgaaaacaactatattattcaaaacagaaaaaaatttaatgagaagaatttgtttcacatttagtcaaatatcttcatgtcacttaagagaatacatttagattttcataaatgcttctgtgttcagtctgatagaatatgttgttttattgaaatatatgaagagaattttcacgcatatgtgtggctggaaaagggagtgttttaattgcctttccaggtaactgtgaatatccttctttaatatcacgtcaaaactctacaaatggtagtttattaaattagttgtgtgaaatcaaaagccatatcaatgaacttttgatttatcttgtcctttgaataagtcttttacctaatcatgcactaattatttggaaaatggcacattgttatgaaggtcttccagattttgacaaattttattatataatatccaaaaatcgcatttgttactatcaccactaatgtcatgagaaaagttgtaatgtatgggtaggctgtcaagctcccagtggcaggtaaaagttttcccaaattccaatttcctcttgaaagctcgaattttgacattgacaacaaatgctgtcatttgcttttcctgaagtgacaggctttccctttgttcatttttgagaaaatgtgtgccgaatactcaagtctgaataaccatagtttgtcagttattctttcaagtgaaagtggtgttccatgaaaaaaagaaaagtggcttattcagctcctgactcaatcacacaagtgcttttcctagagacaactaggacacttcagtatgcagtcaaatactttatatattcctcctatttcatcatacagaatgttaaaaatatgtatttttaggattgtgcttgaatgaaattaatatgtactgcttcatcagagatgtattatgtgaactggcattatttttcttactgagagtgtgcagcaatgaagaaaatgcagactatgcctatagtttgatgctactgcattgattcctgctaaagcattagcagttttagcacatgcctattgctttatcagtgcaagtgccaaaacagtgaaaaaagacaaatgccattttggtattattacgaaagtagtttagagctcaaagctcccacacaaagggccccaggaatccccagttgtctaaaatctatacttcgagaacaactgccctagaagaaagcagttagtcaccactcaatagtcaaaagaagagaagtaaaagatctgactatagctctggtaccaaaaggcatggacttagaaatcagaactggattcaaggcctgactctgctgtgttcctgaagcttttttattctttataatttccctagctgtacaatggagataatcatagttcatactttatagagctaatataacatttaaatgagaaaatgaacctaaagggtgagcacagtgcctggaatacattaatagtaggccatcaataagttagggagaaaaaccacagccagaggagtgtatttaatgcacaagtataggagagagaaaaacaatgagattttgtgactgacttgataggagatgtgaattaaagttatagggttaagctcacttccaggtttccagcttaagccacaaatcgacattaacccaaatagagaaatggaggtttgtaaggcatgataataaattctgtttggaacctgttcagtttgagatagctgtgagacatctggatatagaattaaaatatggatctgagactcagaaagctgtctgggctcgggtaaagttgattaagaagttactggatgagtctgggcatggtggctcatgactgtaatcccagcactttggaggctgaggcaggaggattgcttgagcccaggaattcaaggctgcagtgagctatgatcttgccagtgcactccagcctaagctgcaaaacaagaccttgtcaaaaaaaaaaaaaaagaaagaaaagagcagtcactggttgaagctgaagctaagaatattcacggcattgcctaaggaaaaaaagtgaaaggatgatgagtgaagaggcaagactcacacaactaccaatttttaagtaaagggaacagagaggatgatagacaatgaagttagaacaattacctagatgccaaagaggaatttccaagatgctaattaaaagacatacttgggatttaacaattagtccaactctctgcctgtaaaataaatgaagaacagtcccaaagaagctaagtaatctcctctaaaatgtctactgacaaacacaaattatgaccttttctattatagttgacatatttgtcttgaatcttactattatatgatttgctctaaaagatctaagctgtatataaataactacagaaaaatagatttgactagttcatttcagttttctagcctcacctatcagtgtactatgatgctaacataatcttatgaaagtacttgaagccagccaatacaatgagtacaagactaatatttgttaatgaatcagaatctagaaaaatagcattgtaaacatttcggatatgctgtggtgttactaaggaaaaatttatttttttccattagtcatggcctatgggttctcatcttgcctaattttccagaacagcagacagtttggcaaattgtattggtccataacctgtagtattagtagtgtctctctttccctctctctgtcgggatttttatgattgtgttgcagtcaaaatcgattagttctggtctgtttccatggaaacaagattgtgtcagaaggctgtaaatttttcatctttatggatggaaagttgctgtatgtcatacaacttgagatagcattaaaaaaatctgtaatgtattttcacgtctttgagaaggagagtgtgagttgctgtgaaggactgggtccattactgaggagggatgctgtattttcttggtatctacaagagactattatagtaagggtataaggtaaaagacaagattgaccgatgaattacctgttgaagaaaattagttatttttcccagtgaaattttcactgagagctaatgattgtctgttatttaccatatattctcaggcagcatatgcacccaacagcataagatttatcaaaggcatacatagagcactcagcacattataatgataaccactggacacattccaaggcagaattaaatactattttctataatttcaatagttttgaaataacaccttaatcagggggctgtgaagattgaataacaataaacaaaattctattgaatgattactatatctcagacactgtcatgccatatatgcatgttagcccatttaatcactgttacaatttcatgaggttgataccattaatatttccactttagagatcaagaagcttaggtgcaggtagactagataagacaaggagccaagatttaaacctgtctagttcagaaaaaaaaaaaaaaaagaaaaaaaaaaaaaagcctaggtacctaagcctgcaaaatgagaagattcttgatgtttgctgaaacaaaattaggataaatcagctaccttactgggaggttactatgtataaagccctgtgtcaggaatgagtggtataatctaagaaatgtagcaatatagtccttatctttatttccacataggagataaagcaaacaggaatgaattaataacaaacataaaacccacgtctactttcacatgtatgctacacactttggagttatttgatgataaattaaaaacctaggctagcttcttctatgtcaggtacctcttgctctcagtgtgttgtcaaggaaatcagcattactattagtctgaataaatctattgagaaagtaactctacagcaagggtatcactacgttatagccaaacacagatgaaatctagaccttctttatgttattgttccgtttctattagctaaacacatgattgccaacatgtgttaactatttaacgagatgatctatttctgtttttctgtacctggactcaatgtcatggctctgaaaaaaaaaaaaagcttagtaaaaaaagcatgggttcatctctatcttcaagataattatcctggaactaattaatttttaggggttgatattttctgtgacttcgtccttatcagatagttattagcttgaagagacaactgctaactagtaacaaaaattaagtcaacattttaaaggacaaatcagcatcactggatttattatctctttaatgtttctattaaatgcttgcaaagtaaactgtgtgtttgaccccccagtattcattccattccagatgtttccttcaagtcccttgcccatctttgtttaaggaccaggtatatgatctaattctggccaaggaaaggtgaggggacttcagtcaagtcattgtctgtaaaaagtttcttcactcccaagaaagagaacaaagagaagatagcattctctgtcctctggacccttttctattgggataaaatacatggcactacttcagccaaattaaaaccagaagagatgccaatctgagagcaaagctgacacactgagggtggcaggtcacagagacatatttacccctgggcctttgatggatcactcagcttgtggacccgaacaacctctgcactgcttgttctgttcaataaacatctttcttgactaagacagttttagacagtttttctagttagttgcagatgatacaccaaataaataaatagtctttggtcagttcaaaaacttgaccaattcagaagccagctcacaaccaagtactcaccacatatttggatgatctttaccccatacagtcaggtgagccatagatccaattaccaaataaatataataaaatttaaagtaaatacagtccagggtaatttactaaatagacaggatgaatgtctctcttaaaagaaaaatatataaaaaactcagttgctgggcgcgatggctcacacctgtaatcccagcactttgggaggccgaggcaggcagatcacgaggtcaggagatcgagaccatcctggctaacacgatgaaacctcgtctctactaaaaatacaaaaaactagccgggcttgtggcaggcgcctgtagtctcagctactcaggaggctgaggcaggagaatggcgtgaacccgggaggcagagcttgcggtgagcgaagttcatgccactgcactccagcctgggcgacagagagagactctgtctcaaaacaacaacaacaacaacaaaaaaacaaaaacaaaaaaaaaactgagttaatctctctttcttacatcaacagcctttggcatcattccattccctaaggtcatctgtgctatgtctccctgtatgtatttgcctctttggaagaacaaactggtagaggaaggaagaaaacacccctctgccttcttttggtcctgatacagctgtccttgttaaatagtagagattttagtttattttccacaaaaacaaacttatacccagaagttgtttagttaccttagatagtcacagcacctttttccggaaaagctccaggtcccttctgtgaattatctcatttattcttacaatatccctagaagagattctttgctcctttcccagtaagccactctactatgaatccttgacaggtatctcatccctgtcaaaccttgatgtggcttggcttcagttttcttgctccataatctctgtagaaagagaatacaggtgaaattagcctataatctttgacatttggcataggggtgctctggctctgtgtctgggttttattccttttttttttatggccctggatcgagaaagcaaggatgatgcaaagcaagatatttgacccttgttaaaagcatgccctagcatgatttaggaagaatgggaccaggaaccactgccaggatcctagggttgggacaggggtgctcccccttctttggcagccttgatccatttagtctttctgaaggcatgctggcactcctgagcatccttctgttcttccctcttgcttccttctctcctcttccctccttacatcttcccctttgcttcttttcctcaaacatctcaaagaccaaagaggtagactagtggaacatgtggttcacattggtgttgtaggtcattttctagttccttctcctctccacctaaaacccagtttgattggcttactaaaataagataaataaacctatttagtagcttctaagagtatattttagacaagctgaggtaaaaagccagcatgctaaatattaacctaaatgtaataaccagatgtcatacttctttccgctataaccaacagcaatggcttagcagagttaaaccaataataataatttcaaagggcaatatatataattctaaaatcagtaactgacatttaaaacaatatttactgcaattcatttatacaatgctcataagccaaactagtcatgaattctcaccagtaaatttcccttggccacttaccataacaaaaaaacattaaatctcacttttacaattttatacatggtctatacaatctttgtctccagatgaactctctcctaagccatcattttttttctctattctgttaccggagtgatggtttcaaaacacatatcctacccttgttcaaatctgtcagtggctctcagtgactcagaatcactttagcaaagtatggaagtgccttcatgatctggcctctgcctctcttctcttacctctcaccaagtggtaacaataacacaaatgctaataataatacccataagacacaccttgcatcagaaattgagcaatagattgttacataaatttataattcttcaataaatgttagttccctctacttcacagccacaagcttaataaatgttatttcccttgtcttcatagtacacaagtaactaagttttaaatactttgaccttcatcctgagctataatgaacatgatgttaagtatgttaaataaccaaaacatcaatttcaatacatttttaaaatatttgagagctttttgctgggatgtggagggggatgaggtagggagggctggatatcgaagagggaataaggaggagcagaagggtggagtttgaaaaagcatcccagaagtttctgatttgcttgagttatctttctttttcctacccttatgaaaattactgatttacagattggagaaaatatattttatggccttggcttcaaagaggagagagtatttttttttctttttcaatcccaagtatccatgggaaatcgcagtgattcctgcatgtggattaatacttcactttaggccacatacttcaaactgcgttatatcttaataagagttgcatctcacttatttttaaaagcagccctggcttacaaattaactattatataaaattggactctaagcaattctgaacttcagtgagcataagaatcacctgtgcagcagggcgcggtggctcacgcctgtaatcccagcactttgggaggccgaggcgggtggatcacaaggtcaggagtttgagaccagcctgaccaacatggtgaaaccccgtctctactaaaaatacaaaaattagccaggtgtggtggtgtgcacctgtaatcccaggtacaggtactcaggaggctgacgcacaggagaagtgcttgaacctgggaggcagaggttgcagtgagctgagatcacgccactgcactccagcctgtgtgacagagcaagattccatccgccccacttcaaaaaaaaaaaaaaaaaaaaaaagaatcacttgtgctacttgtaaaagatgcagatttctggattcaatttctggagattctgcaaaaagtaggtctgaggtagggtcgagggatctgcatttttaatacactccctaagtgagttttgtgcaagcgatgcatggatgactatttgagaaaggatgaactaaaggaatgagtaaagaatatgatctgagtgcttttggcaatcaagcctggaattttggtgtaatgtccccagtaactaagaaaaaattgaagcatattggatcacatgaattttgttctattttaggaaaaaacaaaacaaacacatttcctaaaagttgtatataaaaagcaaacatttttcaagaactaaactgaagggtggaaattttgtttaggatatagtataaaggacatgaggcaacatgctcaacagacatcttaaattttattttgcacagatgtgtacaagatgcaaaaaagtctttctctgatggttgcaattagttaaactaagtgaatttcatttagaaggtgatgagataagatggtccagaaactttgctttcagatgacctaatacatttattggatctggaaatcccccaaaaacggttagcctgcatttgaaattatcttaataaaatttcagcattttagtaatttaggagaaattctttggttttcaaataaggaagtgatagctcaaacagcatgatagaaattttaccctaaaaatgctagatgtcaccagctgaggaatcttagacaaattaaatctttaattttatttttcttaacccgtttctacttagtattgttattaatgcttatgctaatatcaacaattgaatattctagaggcaagtttgtatcctcttttgtggttattttagtttatcctgaaaatttatttatcctttaagatcttctagttcccagtgttgtaaaatttttgtcttactatggctccattattttttagcatcattttgcatctttactctttatctctggccatggaagcaactttattttctttcaattgtttttatcttcctttatactgatgacatgatatacctgcttaagaatttttcaggttacaaccatttgtgtcatgcagtaggctgtaaaattctggctgttcagcattttgcacaagaacagaagcagatccaaaggtggtcatggaggaactcacaagctttgccatgaggaagggacagctttccatctaggtgggaatgtggttggcttttcaacctctgtgatgaggtaacagtctcaattaccatctgctcacttggttttaagacttcaggtccctatgaaagaggtaacttcaaatgggcaaatcaccaagatattagagggtgaaatattgaaatgttgtctaggaagccaagttgtccattcagttcttggggagctccagagattctccttgtagtaacttcgatcaccttcgtggtggttcatgttaacttaaagtctgagacttctttctttctttgtgttgtataaaattcatttcttcctttaaaaatgttgagctcaggaggctgagagctaagtgtacattttgaaagagtaaattcattagcctacagtccttaacagatgtatcacatacattttctccattttccttgtcttgagattcctattgcacaaagatatatatatataactttatatatataactttatatatataacattttatatttatatataactttatatataactatatttatataaaactttatatatatataactttatatatatatatataaaactttgcatcactttttagaagaggtgagatataataaataaaaatcaagttcctctatgtgatttaaaaggctttttcattctttagcatgattctatacttcttataaaccatttttttctcaaggactatacttaattttataataaaaataaatattaagaaatgaacttggaagcactgtatcctaacattgaaaataatctttcaggccatctagtttcatcaacctagtttaaagcagtggttctcaaaatttagcatcagaatcaccgggctaacttcttgttaaaacacagctttctgggctccaccccaggtatatatggctgggacccaattttgcatttctaacaaatgcacagataatgctgatgttgccagcccaggaaccacactttgacaatacctagcttattgaatccaggattttacgttgttttttttttttttttttcaggttagaaacatgtatactgggcatatcactttcatttttgcagtttcttaaagatgacaatcatagcttcttcagtctcatttatttattcatttgatgccctatggtgtaatttcgctgcacctggaaccttgaaatgatttacagcagtattacacagaagcctgcaattgctttcagtctccctgctgccagcctgactcccatatagcctgtttttaccttgcctgtcagagtgatttgagaacatagaaatcgaatcatatcattcctctgctcagaagcccccagaagctacccagaaaaaaagtcccaaatccttacaattgcctaaaaggccttataatctgtctgaccttttggttatctagtggaaggcacctccttctattctcctcctccctcagttctctgtagcctaactggcttccagctgtcctctgtacctggaagcacacacagactattcccttattccagtatgctcttcctctaggaagctgaatgactaactcttctatctccttcaagtcttggccaaaagtttactgtcttaaagagacctgctcacacttctcctctaatctcttaccctgctctgatgtttccaagtcacttatcattttgttaggtactatataacttacttataatgtttattattcattttatgtctctcctggatagcacagaaacagcacaggggctggaatatttgcctttttggggtctattttcaccaatgaatctcatgtgtctagaacagtacacgcacatagtagtgctcaatgaatacttttttaaatcaatgaattatttaattttggtttctgaaaaatttagtagtttttttttttagatttattatttggaaattcagcccaatctttagaaactcacatattctatttatggcaacatattttataatagcaatgtctagaaaaaatgaaaccatccactaatggggtattgattaagtaaatcagataactttgttttgtattatatagatattaagatgataaaacataaaaggactcaatataggaaaaacaaagtcaaactttataggcactatatttattaattatgtagccttatttaatctaaatcaaaatacatacattacaatcctctttacctcaaaaataattatataactatgccaagtttactagactctcttgaaaacaaagcaaattgaagactgaatactttacctaaagtatttcccactctaaaatatcttaggaagtaagaatgataatagagaacagtgattaagcactggtcacttatcagggactgattacttcatttaatattcataacaaatatataagataaacatgattgttgtttgtattttttagataagaaaactataatgttcagaggggacaagtaacttgcccaaggtcacatgactagtaaatgttgccatcaaattctataattttttctttgggaaaattaatcaaagcctctctacaatgatcttaccaatgaacctctccagctacatcttacatactctgtatatttccattccttaaaagacctcagcctctgacatctggcgttcaaaaatgttcacgctgtctgaaatatcattgaccaccaactgtcacctcttaaaatcctactaaaatttttacagtaattatatatattctatcttctgttgttattgaagatgtgccttattgcttctacatttattattaaattccttgaggagaaggatgtattgactacctaccacagtaagcagggcattatcagatatatggtggatacaattgcccaaacaaatcttgcaaacattctgttcaacgtggtagccattgaccacatgaggaactgagcatttgaaatgtgggtaggtgccaaatttcaaaatgatatttaggacatatcatcttaaacaaaatatatcattaataaaatcaatcttattgttttctttttttgatattaaaatctagaacatttaaaattacatacatgggactcattatatttctaacgcactgtgcttttttcagatatacctgttccctactccatcactctcctccaagggatcaaacccatgaacaaatgcatgaattaagcaagaggcgaatcccttattctgagatgttctacatgggggagggggctgtctctggatcaatagtttttctattttatgtagtcaggttgctgcttttgtcttttggtctaagaaacaccatagtgaaaaagctacttggtccataagtgaacattctctctctgtgtgcgcagtggagcagaaaccacatgcaaatcagaatataacagcattacaggaagctttctattttgaagtacattggcaacatgacaaatataaagcaaacagcattctctgaacaatccttgatccctttcctaccccaacatcagccataatagacagccctatgtgttgccctcagccacatgtctcctactgcttgctggtaccatgtgctttaggcagtttctttccaggcaaacacagactgtttactgactgtaatcaaaatgacagcccactgttttcacaactgagtgttgagagtcgattgcctttttcacttggcaacctgaggaaaattgagaactgggaacttgaggtatgacttacattacttcaagatggcggtgttgactactccacatgttatctgcgctcctttgagatttaaaatacagaggattgggatttgtctagctcagagcaaagaggttttaatcactgctttcagatgggtgcaaatggtaaaccacactggagcacaggatgatttaggtgtgtctgaagttcagctgccatttgattcttcatcagcaaaaaaccaatcacataaagaggccttccccactaagcaggccccttagatacacagttataatgttacacagtggatcactccaagatggtgcctcagaagataatgcaatatactagaaaaacatgcccctgccctatctttattagaaatgagatttaatgaaaagataagagagaggaaaacagaaggagagatatacaagttgcaaatcagacaaactattctagacttgtctctgctgtcacttgtgtgatatattgaacacatgagatctcagatgtttcgtgtttatgtgagtaaaaaagaagggagaggtgggaaattgaccagttaatttgtagtacctcttttatcactaaaactctagttcagtgtccagactttgggactctgtactaggcttactccaaatgtttgtcccttctgagagaaacttctgagggtatagcaatacccttataccctgaacgtgggtcactaaaccttatataaatcatgttcctgaggtaggtgtgtcacatctattagaggatatattcatttttagaagactttagtgaactagatgcttgcataggtcctctgcagcccaaatttaaactgtttcttgataaataatataaatgccttgagtagaatataacttgaagatcagttgctgaaaagaactatcccttgaatcctttctaactctagatattcaattttgtacacatgacatcttcatgaaatggtaatataaaaaatctcctactgagaaattccatacaaattgcagttaaaagaaaaacctagaaaactttaagtctggttttcagtgaaatatgaccagtcacttgaccatatctcccccaaaaagggccctttgaaataaagaaaagatgaaaaaaaaaagtctttcctgggatctgaattcaggacccagagaatctgtgtttttccttcaggctccgagcacatcattggcaccaaaatagagcaaaggactgtgtgcactgccctgatttaggtgtggatgatgccacttactgcagcggggaatgcagagtaaaaggtctctgcacataaggacaggaaggggatgctgttcagtgctcaattcttttgaggctaaaggagatccagaattccacaggtaagagaaaattatatatgataaaaaattttgttttaaacagggattgtagcaaccaaactgctgaagactggcgtggtctgtctgtcttcaccctccagaggatagaggacctggtaagtaagaaactgactagtgagggcagtaatcctgaggagaaacctaagaagaggtgagagggaagatgccaggagggagagatgccctgccgtgtgccaggtgtgccacctgagctgtctcctcaaggacatggaggattcaggatcctgataaaattgccagtgcaaaatcagacattgagttcactcattcttcaagtgtcactcctctttaaaaattaacagactttttttagaacaattttaggtttacagaaaagtctatcagaaagtattgagttcccacatcgagtgccctattgaatgtcttaaatatctgtcttcaaaatttttattgagaaataaattgagagaataaatagaaactattttgttaagtgtgaaacttcccaaatttagctttcttgagggatgtgtattgttgggggagaggaggaagtgtattattttctgattaaattgatctcacagtgttttctgaactggcaccactatcatagatttaatgggatatttaaaagaaaggtgtcttacaatgacaggataattttaagatactgagtagaaaaccattccttaccaatgcataagagggagctgactattgttttcatggtgtatcttaactctagtgtttatttgcatgaaaatctgcatcttgatttggatgtgctctgccacttttcatttaccttcatgctttaccctttccttttcaaaatgttcaaagtgcttttgaataaggagttggaatgtttcctcaaaagaatctagctagttcttacaattgtcatcatgttggtagaggggaatggttatatcaaccataaattattccccctctgcactgattgtgttatttaaggtgacccttcttcataaaagcattcctcccctggttcaggctttcattcttatcaatatctcattggtttcttatttatattttcattgcagacttcccaaatcctttgtgtataaaggttggatttttttttttaaataaatgatccaatcccaatgggaggacacaagcactgtgtcacacacattcatcataaccctggcctcgaacatgataactttgcaattccttggccagtatttcttctgtttattacagaagcaccagcgacctgcctcaaaatgtggatattctcatcttgagatttaacagatattttctgttatgataatcattttactgaccacgttggcagaatgttagagatgggtgaagaaagcatagttaaatactaatactaaatgatgatcctctagggaaaagactttaggatataatcttctctgaaggacctgtagaggattgccctctatgtctcctacccagctgtgggaaaccaatccggaacagcaactggggtgttaacccaggaaatgtctccttaaaagctgactcatcttaggaatgagattctttttaagaaatgcaattaattattaatttcgctccactattagattaattcacttctttctcagatatgccattttctgaaaatatcttttaaaatgcattttggctttaaaaaatatgttcgtttacagaatctgcctttcctccagatctgcctaaattgcacttttaaaaaattaaaaatcaaagtgttttgcttccaactggtgatttggagattcaaagaatatctttcagtagacctactcttattcgattattcaagatttagttctccagatagcaatttgtaagtaagaaataaatcagtgagtgaatgtatagttgtacaaacttaaagttatggatgctcagctccaaatgtgtacattgtttgtatggttagcttgcaaaatataccataaccagtagctgaatcaactttcaaatatcattgggataataaattaacaatttcaaatgtaaaattatttaaacacataaataaatgccagtgtgttcaaccaagggagaaatggacacaagtgtattttttgttgcttccttaagtatttgcataatatctttacttaacacatgcccgctggttagcactttgaaattattttgaaaagcgtttgtcaactatctttcacttccctagccaagttttcattggcttctgttatttttctttgtctttctctagtcaattggttttcaaacctggctacacatttgaactacaattgcagagcttttaagcaaatattgatacccagattccgcctcagagaatctgattgaattggttgaaggtggagccaagcattgctcttttttaagttttccaaatgattctaatgtgcatccacagctgtgggccactctgtgaataagctgttaatgttctacccctttttgttttctttcagtatgtttgcatatctctttctctttagctgtgttttttttttttctcctgacatttttattggtgaggtcctataaatctatttttttcttttctcattttgcttttttcttttttacctcctatttactggccaagaagttctcattccaggtatatatatttgatttatattcttatcccatactattcatgctttatgtcagtgtaagagaacacaatatgatggtgaattatatttttgcctgttcttccaaagctaatttaatagtttacattaatttttggtataaatataaaaagatcaatagtagaaactaaggccattgtcaaaaacggatattaaggaaggatttattttaaatgtagttattattggctatgacaaaagacaataaaacagtttagaattttgagaccatacaggtctcaaggacatgtatatatcatatcaacagtatttttccctttcagaggtaaaggacggcaatgtgtttgccctaaattttaaactttaaaaacaaatttcaatagtatttaaagaacagagtggaagtgggaatattacatattgcaacaaataacatagcagaaacaagatatcactagcaacagaaaatagcaatagaaaaaaaagaaaaaaaaagaatcaatgctgctaagtattgtgatgatgttaatattgggaagaaaactagaaatcaagaaggtaatgcatagattcaaggatttgaaatgaaacagactgagcctagactaggagaaaaggaatctgagtgccaatgtagctgtgcttctaaatatggtcaagaggtttcctctccatgcggtttattttccccaactggcgaaaatactggttagattggcaaaaggagaaaaagaaaccttgcaattccttggccagatcctgcctacacatgtgttttattgaatctatctggtattataaataatttgaaatagatgattccatttaacaacagagggaaatatttactaacaatttggatttttcagcttcttcagggaagtcatttgatgtaacagtctcctagcagtgagaaggcgttttccattttaaaaagggcatgcattcactttctagttcctcaggcccaacatgaatggctttactgctttctcttacctactttgcccatgcaggaatttatgttcgtttcttctagaatttattatttaaggtcatgaccaaccattatataaattccatgaaaagaaaatgctcagagtacttgggaacatgtttagttaggcataataaaaacaacttatatggagaaaaataaatgtcacaagcagaaacaccaaggagacagagaaactaacaaacaggtgactagtcctcaaatagaggcttaagcccacaaaacgtgtcctattaaaccttatgcaagaatatgttggactctagaccagaagcgcaatgtcacttgttagaaatatgaattggaatttagtgaattattccagttcaagctctttcttgggaaaggaaaaggacaaaatgttctgtacaaccaaagtaagaataaagtatattctgaaaatcaggagattaaaattcccaaaagggagcttcttggcagaaaatggtcaaagttatttaaagagtgactttgaattcacccattgaataaaacaatattaaaccactatttaataattaagggaccatcatttctctaactttgctccagcacagagtttaatcacatgaagggctccctatatgcagtctccaaaaaaatgaaaacctaattcaattcttacagaaataactccagatttcataaggtttctctgaactaaaacccctgaaaattcatttatacaaccacacccagcatatgtttacatgtgctgtattttaatattgtaaacttgcttgcaagttacttttcagttgttctttattcatagatcttgggtaaaaccttctttaaagttctttccagaatgtcctttatcatttcaaatccttacaggaaagaagtgggatattaaaaaaagtaataaaaaaaaaaaatacttggcacattgaaacttgtggtatccagttaagtaggtattcatataaattttaaagaattattctactttaacaaattatatttctgatgtagattcagattttaggtatccaaagagctggtgcctatcaggaagttaataaaacaaagtatgtctgtgcttagtaaaagagcaagattttatttattgctgtattattaagaggaaacactattctgctccgaaataggtgtctgcacttgttacatcccattaaaatataaacaaagaatgtgttaatttcatcccagagggaaaaatattttcaggtaaagctgaactaaaacagtagcttctcaatcaaagataaatgtgtgaaccgacaatataaagcaagaatatgattttctttcttccaaattttctaactacctcaagttacaattgttcagtctacctcaagaagtaattcagatgtcaggttctatatggatttgccatgaaagttgtttataaggtaaaacgtaagcatgacattttgaaaatgaaagcagttagaattaaaattaatcgaaaatttaaaacgaacctaaaagtacagaaatagagttaagtaattatatttcactggtaggtgggtaattaatcctcacagttttggaaaactggtaaaacaaccattaatattaaggtgcgaatgaataatatatttttaggtgacaaatgaaacatgaattcccaaccttcagtgagttcatgtttctatacataaatgaaaatcagaaaaaagtaatcttcacagctacctatgtaaagaaatatcactatataatcaagtgttaatttcttggtgaaaaaaaatctttaaatgcttattcttatggatgcttttagttatcatcaaccctaaagataagaactcgtaagagctgggagtgacctagaactgagagacagatgagcaacaaattccaagcaccgcatttgtctagttgagaaacactaccctcatatttttaagcctcccaagctcttagccctctcagatctgcctaatcaagagtccattaagtcatcttggctgccatgaagatgaagctgacagcgcagttacttgagtcagtttaaagaggcctagggtggttgaagggaaggattaggaggcctggggtgctgaaaggtcatccaagttctagctcccaaagaccccagtagcacacagctgtcaggagcacgaagctacacttagaaacaacctttggaggaaagcagggattttgcagtccatcaaccattcatcaagcacaatttgcctttccacatcttattgtaccgttaatagaattgaagcattagagagtttgtgagttgatcacatagcaaagactttcctgagatttaggttcagttatctggtggtcttagtagaaattacttggcgtttaaatgtggttttggtgaaacctagattccctttgtgaatctttacagaaacttcgtctaacaggtatatcctcttaaggcaacgtgaaataaggccctttgcctctattttcataagaagaagaaagttttgaagtccgtgataacatattgggcataaataactgtcttctggaaggcattatgagttctataaactctccaggaattgcctggaatgttaacactaagtgatactattataggtacacaattgttgttgtttcagcaagggcatccttccaggatgagaattattcacttttcaggtacataattatttggcagttttattctatccttcctgttgtggtggaagatattatatcaccagcactaacgataacaataataacaatgatgaaaatttatgcctttatgtttgtcctgttccttttgatgtgagttaggatggcagggagagagaggaaggaggttcgtaatcatgttccaggatctataccaagcactgaacagacattattttagttacacaatcctgtaacacaggcattattattcctattttaaagatgatgtaataaaggctcagagagtttaaataacttgtcaggtaatagtggccataaaatgtaacctgccaagctcttgctcttaaccacttctccatgttgtttcctgcttgtttccactacagaaggaactggccaagaaacgcccctatttctctattttaccactttcatgtttagcacatcaatcataatttacaactcagtgagagtcaaagttgtatcttaattaagctgagaaaccaactgaagaaaaatccaaataaatgaggatcagaaaattttaaaaacaaagtattcttatacagctttgattctaatttccttcctttgtaggcaaggaaaatgctcttcagtgatacttggggtcttttctgagacaacaaaactcactagtagcagaacatgaaccagatcccaagactttcagctcagggttcaacctttttatcttcagtactcaaataaatcacagcatttttctcaactttacaaatgaaatcaccactacattcttttaaagagtaagttattcaaatgtgtttgatatatcatttaatcaaagcaggtttaatttccgaaatttttgaaagagcgcattttgtgaagtgaagaactctgagtgtatttgctttttcacatggcgaccacatgtatagatgaataactaagagactgttgcaactataccaagaaaaataaaagctaacatttggggccaaaattaagcattcattcataaatgtaaaccagttcaatcaagaccagctctgatgcttactcagaacaaagttactcacatttagtcacctgtagagaagcatggtgtgtacaatacactcaagttaattaacagccatttctgggaaccctgtccaaagaaatagttttctttatctcctatggtaggaattcttctgaaatagacaagacccagggctctcctctcaggcaaccactattttgaaatgtttttggggggactattattgctactcaatgtaaaatattaagtgagatgtcaatatttttcaacatatcattaggaattacagtttggaggccttaagttctatttttgaagcccttttagccagtactgactggaagccctgttgaaatcagaagtcttcatttcatatagggcacactctatttggagtgaatgtgatgaaatgtttccatgcaaattcctacaagcacttatgcctttatctttgtcctcataagccacattatactacctgttgtgtattttaaaaccctgtatgatttttaaaacttatctttcaattaatatgtatagattttctgtcaataatttcttattctaattatgtggtggctaactgaatgaaacatttatggttatgatatagaatattctaaatacaactacagacaatatggatcatagataaagtaaattattgttttatggctccagtggttcttcctggtaattaataaaaataaacagttattaaatatatacagaaaaacagcaatctatcaagcttatagaacaattaagaatatataataatctttaaatcaataaattaaaaggtaaacatttaatataaaatgaatatattaaaggataaagaagtagcatattatggaacatatagagattattttattttttgaaggttcaacctcttttaaatggttagtattggtgttcttttctctatgaaaacagattttagagaaaaatgatagtgtatttcacaaagccaaacacctctatattgttatcactccctatatgcatggcctctctaaagctgttaaataaaaaactaaagcacaagaatgatagttccaatttcactatacatttatgtttaaaaaatactggacacactgggcatttaaatagatgacatacagccaggaaactcattagactagctttaagtataataaaaaatattttttctgaatacaattaatcataagcatctacaaaaacacaagaccattgatgcctagtatgtaccataaatcaccatttccagacaggctctattttctttgaaagataaagaaatagtaagcagtttacacatcaaacgatgcctttggttcctgtaatttacatttaaacaacactgggttaaaaatagcagcatgaagatgattttaaagtaaggaaaatgacctggtagctaggttctatggtgcagataatgaaatgttttgtcagcttacctgataaaacagagccttatgaattacagcataacaaagcccagcatccaagatggttagggtataacgtgtcttcctctgcagctgttcagcttttttttttttttttttttttgaccacagaggtttacaaattagttacaattttttttctttctttctctgtggataagaaaacaaagagacctttccagaatcctctctgcttatgcctccgcttcctgttctgagattcactctatggt

SEQ ID NO: 1597 - DNA, 116548 bp, Homo sapiens; identical to SEQ ID NO: 1596

SEQ ID NO: 1598 - DNA, 116548 bp, Homo sapiens; identical to SEQ ID NO: 1596

SEQ ID NO: 1599 - DNA, 819134 bp, Homo sapiens
cgccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagtgagtcaacctaataccttttaattttgtgcaaagttctctgttttaataacttttaatttagtgcatatatcatatactggagaattatcaatttatttgattcttttagcaatttatattttggtaattctgtgttaataatgtgatttgtatttggttacgcagttgccgataatcctgtggcattacagagtttgatttatgcggacgatccttggacttaaaaaggattactgaccatttaagaaagattaattaatgagtataacattgagtcctaactctgctaatgcttgtctaagctacacacagatacatgcacagacacacataccctcaaatctcataccaaaaatgaccaaattacaacaaaggggatagtatcctatcctgctaggccatcacattatggatcagcagtgtagagcaagtcttgtggggcctgatcttgctcttacaagctttgggatcttgggcaattcagtttccctaagctcagttccttatttatagtcagtgagatgaatcctatggtctcttaggttccttttatttcgtaattcaaaaagttgaagttagaggttaataattttgtattggtaagactgcaatagcagtcttcttcttataattaataaattaagaagttacagggaccaagggagaaaggtaaattcatttatagggataagacaataaaagggtacaattaatttatttggtcaccagtgttcttgttttcttgctgaattttatgggatgggaacagatctaggaaggaaggctcgtctgtacccttttgccctacctgacgtaaaactcaggactgacccatcctaaaatcattcatttagaaagaatccctcataaccatgttagctcaaggttatcttgtatctgatttctctcttcctgcataggttgcagactgaagagcattaaaatatctgttttcttagtggttttcctttctggatttgaataattcacttgattcttccaggctacttaaatgaaagagtgttatctaagaatgctaatcttagttccttttgtttgagattagagaaatcaatgcattatatttttagtctagatagtaagtcctgaatgccctttactctggccatttaaaaaactaaattattttcagttggctttcatattgtggggttagatattcatttgagatatgttttcttttttccttttccgttcctttagttaaaacgaaatcttaccctaaagtgggataataaggggaaagatccattgaatttgagtattgggcttagtttgcattaaatgctccttttgttcctgtttatgtattattttaagctcgtttttccaaatataccaacagcagatatcaaatgaccattacttcatactagaaggaatttttataaaccaggccaaagacttcactagatttctcaaactttgtttctaactctgaaatcctatgattttatgatttttaatatattagagtaaacctacaaaattgtaattttgtaggtgaacaatagttagacagtgtcggtttcatatgattcaacctacatatggaagcttagtcattgcattgtttaggaaaactatgtaactcatgtatgaaaatggtaatgtcaagcaacgaagcttattaagacactaacatcatttttaaaatttagttttgaatactagatattaaaaattatattttaaacgtttgtaaatccagtgagaataaaatgttctttgcatatcttatttcttttcacagggagttttttcctgtgttttatgagaaaaatcacaggcattacagtttgaaatcaatttcattgttttcattgcaattgctacatagctgttgaatatttgtagtaaggtttaatgactaatgaagtgcatgcttgattatatgccattagtaaaaatatatttttatggcaaagggcggtttgcagcatggcattgacaaaagcaatatgtaaatgtgttactccccttcaaaagaatgcaaatcagtataaacaaattttaaggaaaatatttaaaaataaacaattaaaataatggatatttattgtttgttacttattgagatgatatgaatatgtaaatagagcacttaggtctacttattttcagaggccagtgtactactaattagaaaagttgtagatatcataattactgtagtaaattaatttgtctttattgcttacattttattgcttggtattccaggcattggatagatagttacaatgctgacatcaagagtgttcccacgattatttctccgcttttctaatcatcaactcattatatgtcccttatcctcctgctacttattatcacttgccatttcactcattatttgctcctatctctctgtctttgctcattcaattctcttttctagggataccccttccttccagttcttacctgccaaagctgtgtttggcttctaatgtttagcttaatgtctgcatcttctgcaatgtctttcagatgtctgcagtcagaactctttactcaaggtcactaccgtcagcttgtctttccactggagctcatccagaacacattgctttgtgaccaaacacattctctctgtatctgcctcccaattagactgtgtacttctcttccccatgttccctcctttgacacaagtcatgctcttctaagcaatccaggcttgttcagttgaattattttctaaaattaaaacggtatgccagacaaggtaatacaagtctaggcttgatttttcctgagtgttgtgtttgcggtgggtgggccaattatttctgttccttttcaaaggatctcacttatcttcttgttttctgccccattggataaatcatctcatgtcatcatttatttaacttcaaacacaatttctaaatgttgaggaatacgagaacaaaaagagcatgtctgcatctgcatacatggtcttaggtattgggtgaaagaccatcaaaaacttatattagtactaggaagaacacaattattttaaaatacattaaatgcataataacttttaaaattaagggtcaggaagaaatctctaatagaaatcacaaaacgatagacattttctttgaccattcttgctttgcttctctaatgtatatttaatattaatataaataacagcagtaatgacaaccataatggccactaccatgtcatagaatgtactatatgcattcacgtgtttcatctgatttggtccacatatcataacatgaagttggtgaggctgaggctatatatgttattcagactcaagatagaaaggattcattaggaaagggttcatgagaaaaataagcttaaagcacaatgttttcttccaactttccatttcaggggtacatatgcaggatgtgcaggtttgttacataggtaaatgtgaagcagagacacttttttaacatcagttctccagtgagttcatagcagattacagggtcaaaatatatatgcatacaccatagtaagcaccatttaaacttgtagaagtaagaaaattgtccttgaatagtcagttcaatcttcctgtgctctattgagtgtatctatctgtggatacaaaatgaataaagatggatctggacatttcacccttccgcatatgggagtaaaacctataaggagactaataatatcatgcatcacaaattacttgctgcagttaaagaagttttattcagatcctcatgatctcacagggatccagtatcttgagagttgacgaactttccataaaaacactaatcacgtataacagttcagtcaaaatctactgatatagatattccaaagtatggcaggaatttagaacaaaagatggaaaatttgaaggctctgatctgtaacatttcttcttaaaatatttcagctgacttgcttagcctggtatgcagaatctggtgcaagctgagcacggtctaagttgcctcatcatctcagctctccatgcttctgtatttgtatacttccatacttagcaagtaactgttctccctccatggaatgtattattatcctctgccactgtcctcttaaacctggcaaatgcataactttcttttgagacctacctttgttaagacctagctctttgaagacttccctgattgtccaaggtaatgttgactttactttgtaactgtatgtatttttcttatgtcagcaaccactgctctgggttattactatatttttctctcccaaataagacaagaggttctgttagaagtggaaccttaatatccatttttatgtgatgaatttctaggcccatgtgtgggctgtattaaaggattaaagcaagcttgttcaacctgtggcccaggacagcttttattgtggcctgagacaaattcgtaaactttcttaaaacattatgagattgttttgtgatttttttttagctcaccagctatcattagtgtattttatgtatggcccaagacaactcttcttcccatgtggcccagggaagccaaaagactggacacccttgggtgaaagcttattagtaatgagtaaataaacaaaatggagtggatgaatagtgtagttcactatggacaagttaaataatgcttttctcaatgataagggcaaaatgaaaattctgagatttctacatgcattatccttgaaacctttagtattttacatgtagagaggtcattgttcagactcgcatttgatagagtaatcagtgttgaagacattcccaatggtgtaagttgccatacttctgcagtataggctggttgcccacaggaaaatattggagacaaagctgaaagcaatgtaaaaaccttgtgaaaaagcagaatgtatctttgaagaactgcacttaatatgttattcagcctaatttgtgcattttaagtaacatgttgatgagttgtacggtagttttcctttatccatagcccataccacaactccaagtagatgcctgcagatggtactgaacccttatatatactatgtttttcctgtgcatacatacctatgataaagtttaatttataaattaggcacagtaagaaattaataactattgataaaatagaacagttataacatcatactgtaataaaaaaaatctatgtaaatgtggtttctctctctgtgtgtctctctgtcatctcaaaatatcttattatactgtactcacctatttttggactgtgggtgaccacaggtaactgaagctgtggaaagcaaaaccatgaataagtggggactgctgtatgtgttgtagagctgtgctgtccagtctgtcagccactacttacatgtggctactgggaaatggaaatgtgtgcccaaagtgatatgtgctgtaagtgaaaaatgaacattaggtttcagaagataagtacaaaaaaaggaatatgaactatttcactattgtttctctgttgaaatgatattttgagtatattaggttacataaaatatattattaaacttaattttatccctatctctttactttttaactgttactgctagaaaatttcaaactgcatatgtgtcttgcattatatttccattggacagtcctggaaaggaaattatgattatccagagaataaagtcattaaataaaaggaaaggttaaataaagtatgacccgtcaggagagagacaaacaaggagagggaacagggtaagtcagccaagcatggaaacatgtggcgattgctcaagggcttgtgctctgaatctgaaaatgctgtaatggtctatgaaaatacttttagagctagtaaatgaaaataagtgcttatataacatataaacttaaaaaattcatgatatttaatgttcaataactatgagaaggcttaatcaacctactgtaatattttaattaaaaatcattctaacgtcaaataaacggagaaatactgtccgtcttccataatagatacaatggatggtttaatgttaaataccctgagaagtcttacagctaaaaatttatcactgtttcaaacagaattgttcccatatctggatgatagaactcactcctcctatgtatttaataatcagtattctatgagatatattttgggagatacttagtagaagataaagtcactgtattttattagggatgaaactgaggctagggagatccctaattcatttgagatctaatatgtgggcaaaatagacagattggtgcaatatccagcacagtttaacaaacactttccgagtagctactttgtgccagttattcattctggcaataagacgaataatacagccaggttggtgaatatcacaattcatagattctcaggtgattgttctcatgttttcagaaaaaggcaatgacagtgtgtacactgacccagagggtgattgtcctgctatacttaattttccaataactcctattgcattgaaactgttgcaactattcttcagaagtatagacattgaaataagtaaaataaaatagtaacgtacattgagttttagaaatgtaccatgtacatgtttttagaactcttagcattttgatttaaaataataaaaattggtgtacgtattttcttttgtagacaaaagattgtagggtgaaaatttgtaaatttaacctaatattttattctcattggtcacatgttatgaaaaattatatacctttcagctacctgtaactatgtcttctatgagtaatcatgaactgtctagctctgctgaagtttttatatttttcatgaattcgtacttaaatcctagcactagagttccttttttgagaattattccttttctctcagctcttctttcaactttaccagcaacaggcacacagagagatacatctgtgtgcacacatgcgtgctctaccttacactctcacattctcacactgtcagatgctcttagataaatacctttctggatgttagtttttcagaatgtcagtggtcccaattattttcctcaggtacagattaaaattttaaccctacattctctgataggtttctgtttaatagcactgatgtgtttttttaaaaaaaatatcatacaatgcaattgcatattttggacattctcatcctgcaactactttccctccccaaaatgtttagattctgtggctgagatacagtaaagtgcacaaaatcatgcaatcatttacttattcattcagcaaattgtcatcaaggcaatgggctagcaattgtggggataataaggaaagcatttttaataccccttatcctgaaaggaaacctttaatgggaagatatttttgctatcatattacatttttttgagtaataaaattgctgtgtttaacatttgccttaagtaacttccatagatagttactttcatgctggcccatagctgtgctggggatagtggtaggcacatctttaactcgggaattagtttgaagttgcagaattgttagtaaatgtagtatttgttgatttattacacatattggcagcaatgcaatgtgtatatactattataggaaataccaagaaaaataaaaattaaaagacaaacagcttataataattacccacaaagggctttttaccatgaaaaggagagaggggatggtgggttcaaacaaattgttctaatagaagatgagttcctaaaagaggcatagatgaagtttgatggggcattcagaggtggggaaaagtcctctcagggggattcagggaatgttcgtggaatgagttggcagtggatttgttcagtgtaatgtggctgcgatttggacatacagacttggtggagatgttcactgcaagttgagtaagtagtgcaaacatacacatagagacaagaaaagtcttagggcgtggatgtgaacagcaactggaggaggttggttaagtacaagcatagaatgggaaatgaatgtgaatgccatgcacaaagcacatatgcattgtgttctactatatatttacacaggtgccttttctttctctggaagggagatttgcatggatgcctttctaggtggatgtcatacccagcgaattctgttgataagctattgccgttgcagtgactgcaataattcttgagcatgccatctttaccagctctgctagagtgttgaatgttcaaaagaaaaacccaagtacctattaaatcatcagatgccatagtgtgtttataaaatcagatgaaagccaatttctgtattagagcagatctacttttctgtgcttggttggtgttgtaaggagagattattctgcttccctaagaaggttaagctgtcatctagttaaatatggacttaaaataatgctgccaaagcagttgcctcttgtgattgatgatgatgatgacagatgatgatagttttgaaatcagttttacagggaaaattgctatttttctactttggctgatgttgtagttctagatttgcgaatttcttgtcatattcgggaacatttttgattaaaaggaaaattgctaaggactgtattcttgatgataaaatggctctaaaactgagctatggggcaaatgattataagttgacttatacatattatttgagcgacagcagttattcttggctttacagtgtcattatgagttatattttggggaacaaatagcaacccatgtctagtcagcaaaagtggcagaaagtgtggtacttagaagttatgataataatagtgtcttactaaagtcatcaaagaactttcgtatgtattactattaaattttctctacaattctctcaggacttcatgcatgtgtttcctctccttgaattgtttttcccctcagatacctacatggcttgttttctttctctagaagaatagccgcaccctctctgcagtctctcattcctccatggcatttatcaccacctgacatgtgatatatgtatttgtttactatctcctcatgctaggttgtaagccgtgtgaatgctgagactggtttcttcagtgcaataaagtaagaacctataaaagttcctggctcataataggtactcagttagtaattcttgaatcattagctctatgaataaatctttattttatacatagacgactgaatattgtggtcatgatataaaaagaagctaatgtttggtgccagaatcaaattcaagcttttcagtttatttaaccaaattgctttggtttgtgtctatgtaagtaacatagacaacaaatagccctgaaaaaaaggagtaatagtgaagacttactcttaggtgtgaaccatttctgtacctcatcacattctagaatcaatcaatcaattttgtttatacagaattgctggtaatggctactctataccactgcattgtgtgagcctgtgcagacactggtctgaaaaagccattttcaggaaggaaaagaaaacagaacataaaccccccaaatattttttaaaggccaataacatttgtatccattgggtaaacacgatcaatcaaagctctacaagccttctatgggttgcttccttaacaaatatgttttttgccttggccattcatcatatctggaagtttgggtgatgagcttgagcactctcttccgttaatactgaaaatagccacttagtggctttgtgaaaagaaaagcctgttaaagcgacagaacaaacatgcattctcctgacgatataaaacaggatattgtagattgtttatattcgtgtgggcttggtgtaatgaaattcagctgaattttaagaagaggatttgttttaatgggaaattaggttgtgaatggaaaaggctacaatgcagatacgaaaggtattccctcgtaccctccaaacgcataaggagttttctaatgagactgagagtagtagctgctaaaagcaaagtcatcttatctgttgtctgagatgaattaccttaaaaaattgtaccctgacctcattactatacattacatatattgaaacatcactatgtatctcctgatatgcataattattatttgtcaattaaagaaaataaaataaattataaaaaaacattgtagatgggcttaaaaagtgaagaaataggtagcttctgtcaccagcactatttagagggattgatgaactattttgagaaggttggggctgggagaggagtactatgaaaaatgaaaagtcacatctctggaagcaggcatgtagtatcacatccaaaggacactgtacatacaaggtctactgcagtcagagagattaaaataatcttccgacctctgaaataggataatacaccaattataagtgatctcatgactagaaagtgtactttttttccaggacagttagtgtgtctgaaagtgagcagctagaaagttcaaggaggcagactcacttatttttggttatagaatgggtagggtttgggccaaataatctagcttgtagagtcaagtttagtcatttgttgaggtttacaggaagcacaaagagagaagagtagttgaaacagcataggttgggcaaagaattaaatggtgggataaaatgggtcttggtaaaacatgtaaatgagattaaatgagctggaaagaaatcaaccaaacaaatttcaaatgctgaaggtaatagagtgggtaatggttgtcccattatgtggtggctttagttttcagtcctagtaccacaatgccccttgccatagaccttttctttaaaacaaacaaggaatattcttatgccttattttctacataatgagtgtttttattgattttagatttttttcaagatccctatagagggattttgaatacttttcatttcctgctttaaccaggatgtctgccagaaatggatgtaaagcagtgcatggattttaaaataagaaagctcttagaatttccttatccatttccagtgctttgtgcattgctccaaaatattgctgttttcagtatgggttttgggtctcatatagagaagatggctcatttgatcgaataacatttcatataattgccctttataatttaacttttctatgtaaaatcatattcacttctgtgtgatcaattacaaatataaagatttaatttcatgagaattactgctccttcaattaatagactagagaagaagagattctacattttcccttaaatggcataactaattaatagcgaaatgtgactagaacccagattttctgaatcatggactcagtgttgtttctcctacgaagagcagatagagtacttgtagttaaacaaaattagattaaaatttcagctatcaaccctattagcaagttatttatgctgtaagcctcttattttttaatctataaaatgaagttaataatagcatttctatagcattgtaggatgactgtagttgataatatatagctagagggaggatattgaatattcccaacacaatgaaatgataaatgttcaggacgatgcatatgataattaccctgatctgatcacattacatgtatggaaacatcactatgtgggaaataaccaaactgttttggaacccttgctcatgaaggaatttgcattttgtcacactatttgcatgttcatttggttttggactgcattatgcatatttaaaacatactaaatgttatccctcaaagaatgtgtaatcttaacagtcctgagtgaagacaaaagtagacagtgatcgtggaatccagaacatactatccaatgatcaatataatacctagtaatttaaaatagagccttttactgattttgctctagttctagttaatgaagaaaagaagagatcattttaaaggaataattagtaaagacacctgcaaattttatgcataagtctgagtaagagaaattctgctgataatgctaatattatattgtcacctatatatatagtgtcatatctaaatattttaaaaataccaaataagaatatcctgctttttactatagaaaagaagctaatggaaaaccgatcatctgaccaattattaaaatgcatcctctctcctataagctctgttgttaatttcgtgatacaccttgaatatgccacaagcaattggtaatagcatcaattaacatttgggaagttcagcatggccacctaagatattaaatatttgctacaggaatgctaatgaaatccactgatgttatattcccaaggtattgtttaccaataacagcaaagctaagggttaccaaataaatgaaggaagatctacttagagctgttttcttcaattattctaatttttgtgttctcattttggttctgagttttctcacctgcatttgaggtcagagtctggaaacagggctttcagggatgcatcactaatgtcctttaggaaatatgtctttgcataatcaacgtcattgaggagacttttataagaaaatgaaaaaaagaatgaatttgactttcccttcactttttttttgtagagccattgccgtttctgtatttggataggagagaaatgaagcattgttatttaatttagcccttattataacatattatgtagtctcttagggtggcatgttaccaaaaacaagatgttctattttaaaagttgatttagtattacttcttttttttaattcacaatacattatgtaggtaggtttttttttctgtacattacacaccacagactgtattagaaaataatgttggtgtagttttattgaagccacatcatgaaacataagtattataaagagaaggctgttttcccatttcaatcagttgtctagttgatgtgtttatttttcatccaatttattttatatactaaaaaacagctcttaggaaagtgagtacatcaaactcagtttcattgatttaattttatttattttactttaggctaagttaattcaaatcaatagcgtgtatgtatttcagtgtaacctgtgatgatttctgctcaaactctacattcacatttataggaatcaggatattgccagatacgcactgatttaatgaatgaagacattgcagatattagaaacaacagtctctaatgaaataattgaatttatttttccctccaacatagttgagtggtgaaactatactcttgataaagttttttattataatgtattaagtacagtggtaaataaaatggacttcattttcaaatggatcttcagcaaaacattaggtttttaaatcacctttattacatttttatgtatctctttttgggatcttattgctttattagtatataacgtttttgatatttctaaacatgtttccaaaaatctgaatttacacattgataaaaataaaaacgacttagtcttctctgtcactgtgttctttttgcacttccattgactatgttccattcatgaataagaaaaagaaaaaaattagaagagatttattggaaagcaaaggtaactcttactactatttcatagaccatctctttgattttgcaggttagtttgtcctgtctgggggagataaaatgtagatttaatatggctaatgatttagaatcctgtctactatgaaacttaactcacacactaagaaaggtgatataaatgctgaatccctttaagtacatcttggcttgatgatgatatttgatgatccactgatttgtcttccaaaacactgtaacatttggttctttctgaaatcatcaatattattgttgtcgaaagacttcagaaagccagattgtctcccaaattgtttaatacttctttgctttttggtacgttttcttatttagttattaaataagttcttagtctttaaagctgatttttaatttttttgtcttttagggactactatattcacaaaagaataccagtaatacatgcacagcacaatgaaaaaaaccaatatgaagtagttgtttgattagtttcagcaatataaatggccactgcaagtagtttaggagccaaagagcattcctgcaatctagaattagtagtttcatttttttttcaattgaattgaaattggtcaaggtaactagataatgctaaatccccagtctactttgtgccgtgtagttattctaatcgtattgaagaacgttgtccatttgtcagcattttacaaagtgtgttaatgacttctattcctgctaccttatttttctgcccattagaataaacagtgactttatgtcacataaaagtagccttatagcctttttaaacgtttatttttgacaggagttgatggtatggtatttatgagagctgagaccagaattaaaaagttgtaacacattgttttagtgaacgaaacaaaagaacaaatattctgccacacgatttataccataattctagaatttactttatccttttataaattcaacagctaaaaaggtctactgactaatttttcttaattaaattattttcttgaaacagaatataagttcctgctactactactactaatctcatctttattggaatcagttaggtcatattgagccatgattactttttcatttttttttttttattgagacagagtcgcactctgtcacccaggctggagggcagtggtgccatctcggctcactgcagccttaacctcctggactcgatctatcctcccgcctcagcctttgaaattgctggtattactggcatgagccaccacacctggtcaagatttcttattaatttaacattttcaactatttctgcatagttgatatgtgtcctattgctttctgatttttttttaatttgttctttttggttattatactttaagttctgggatacatgtgcagaacatgcaggtttgttacataggtatacacgtgccatgttggcgtgctgcagccatcaacccataatctacattgggtatttctcctaatgctatccctcccctagccccccacccccctacaggccccagtatgtgatgttcccctccctgtgtccatgtgttcttatagttcaactcccacttatgagtgagaacatgcggtgttgggttttctgttcctgttttagtttgctgagaatgatggtttccagcttcatccatgtccctgcaaaggacatgaactcatccttttttaatggctgcatagtattccatggtgtatatgtgccacatattctttatccagtctgtcattgatgggcatacgggttggttccaagtctttgttattgtgaacagtgctgcagtaaacatacatgcgcatgtgtcattatagtagaataatgtataatcctttgggtatatacccagtaatgggattattgggtcaaatggtatttctggttatagatccttgaggaattgccacactgtcttccacagtggttgaactaatttacactcccactaacagtgtaaaagcattcctatttctccacatcctctccggcatttgttgtttcctgactttttaatgatctccaatctaactggcgtgagatggtatctcattgtggttttgatttgcattctctaatgaccagggatgatgagcgttttttcatatgtttcttggctgcataaatgtcttcttttgagaagtgtctgttcatatcatttgcccactttttgatggggttgtttttttcttgtaaatttctttaaattccttgtatattctggatattagccctttgtcagatggtggattacaaaaattttctctcattctataggttgccttttcactctgatgatagtttcttttgctgtgaggaagctctttagtttaattagatcccatttgtccatcttggcttttgttgccgttggttttggtgttttagtcatgaagtctttgcccatgcctatgtcctaaatggtattgcctaggctttcttctgtggtttttatagttttaggtcttaggtttaagtgtttaatccagcttgagttaatttttgtataaggtgtaaggaagggctccagtttcagttttctgcttacggctagccagttttcccaacaccatttattaagtagggaatcctttctccattgcttgtttttgtcaggttagtcaaagttcagctgggtgtagatgtgtggcattatttctgagggctctgtcctgttccattggtctatatatctgttttggtaccagtaccgtgctggatttataaagcaagttcttggagacctacaaagagacttagactcttacacagtaatagtgtgagactttaacaccccactgtcaatattagacagatcaatgagacagaaaattaacaaggatatttaggacttgaactcagctctgaaccatgtggatctaatagacatccacagaactctccaccccaaatccacagaatatacatttttctcagcaccacatcgcacttaattattggaagtaaactctaataattggaagtaaaactctactcagcaaatgcaaaagaacagaaatatgacaaacagtctctcagaccacagtgcaatcaaattagaactcaggattaagaaactcactcaaaaccgcacaactacatggaaactgaacaacctgctgctgaatgactactgggtaaataacgaaattaaggcagaaataaataagttctttgaaaccaaggggaacaaagacacttatgtaccagaatttctgggacgcatttaaagcaatgtttagagggaaatctatagcactaagtgcctgcaagagaaaacaggaaagatctaaaattgacagtctaacatcacagttaaaagaaccagagaagcaaaagcaaacaaattcaaaagctagcagaatacaagaaacaactaagatcagagcagaactgaaggagatagagacatgaaaaacccttaaaaaaaatcaatgaatccaggagctggttttttgaaaagattagcaaaatagatagactgctagccagactaataaagaagaaaagagagaagaatcaactagacagaataaaaaatgataaaggggatatcaccactgatcccatagaaatgcatactaccatcagagaatcctataaacacctctatgcaaataaacgagaaaatctggaagaaatgtataaattcctggacacatacaccctcccaagactaaaccaggaagaagtcaaatctctgaatagaccaataacaagttctgaaattgaggcactaattaatagtctaccaaccaaaaaaagtccaggaccagatggatttacagccgaattctaccagaggtacaaagaggaactggtatcattccttctgaaactattccaaacaatagaaaaagagggaatcctccctaactcattttgtgaggtcagcatcatcctgataccaaaacctggcagagacacaacaaaaaaagaaaatttcaggtcagtatccctgatgagcatcgttgcaaaaatcatcagtaaaatactggcaaaccgaatccagcagcacatcaaaaatcttatccaccatgatcaagtcatcttcatcactgggatgcaaggctggttcaacatacacaaaccaataggcagagagccaaatcatgagtgaactcccattcacaattgctatgaagagaataaaatacctaggaatacaacttaaaagggatgtgaaggacctcttcaaggagaactacaaaccactgctcaaggaaataacagaggacacaaacaaatggaaaagcattctatgctcatggataggaagaatcaatatcatgaaaatggccataaggtaaaagtaatttacagattcaatgctatccccatcaagccaccattgactttcttcacataaacagaaaaaactgctttaaattttgtatggaaccaaaaaagagcctgtatagccaagacaatcataagcaaaaagaacaaggctggaggcatcaggctacctgacttcaaactatacgacaaggctacagtaaccaaaaaagcatggtattggtaccagaacagatacatagaccaatggaatagaacagaggcctcagaaataatgcctcacatctacacccatctgatctttgactaacctgagaaagacaagcaatggggaaaaaattccttgtttaataaatggtgttgggaaaactggctagccataggcagaaaactgaaactggaacccttccttacaccttatacaaaaattaactcaagctggattaaacacttaaacctaagacctaaaaccataaaaaccacagaagaaaacctaggcaataccatctaggacataggcatgggcaaagacttcatgactaagacaccaaaagcaaaggcaacaaaagccaagactgacaaatgggatctaattaacctaaagagcttcctcacagcaaaagaaactatcatcagagtgaacaggcaacacagtataagagaaaatttttgcaatctatccatctgaaaaagggctaatacccagaatctacaaagaacttaaagaaatttacaagaaaaaagcaaccccatcaaaaagtgggcaaatgatatgaacagacacttctcaaaagaagacatttatgcagccaagaaacatgaaaaaacacttatcatcactggtcattagagaaacgcaaatcaaaaccacaatgagataccatctctcatcagttagaatggtgatcattaaaaagttaggaaataggccgtgcatggtggctcatgcctgtaatcttagcaccttgggaggccgaggtgggccgatcacgaggtcaggagttggatatcacctggggcctacatggtcaaaccctgtctctactaaaaatacaaaaattagccaggcgtggtggtgcacgtctgtaatcccagctacacaagaggctgaggcaggagaatcacttcaacccgggaggtggaagttgcagtgagctgagatcgcaccattgcactccagcctgggcaatagaatgagactccatctcaaaatcaatcaatcaatcaatcaggaaacaacagatgctggagaggatgtggagaaataggaacgcttttacactgttggtgggagtgtaaattagttcaactattgcggaagacagtgtggcaattcctcaaggatctagaaccagaaacaccatttaacccagcaatcccattactggctatatacccaaagcattataaatcattctactgtaaagacacatgcacatgtatgtttattgcagcactgtttgcaatagcaaaaacttggaaccaacccaaatgcccatcagtgatagactgggctttctgatcttttgattttgaggtttcattgaatattagcacagattttcttatttttttttctgtctcaatatacatttaggaaattacttcctaataagtaagaagtacatctagatagttgttggatgaaatatattaacattagctattgcttaagaaaacaactggataatgttttcctacctttttaatcatctcatcctgctagtgtactgtgtttgctcatgtttatgaacctaccacacataatataattggctctgaacttcctgaattgcaaatcctgtattcaataatttcatgcatgcagcctatttctcaatttatttctgggaactctaatcttttgcttcacagatactttgaactggcatctcatgtcttagtctgagttcctaacctttttatatttttttattatttgtattatttatatattgatttcttatttctctcccattgaaatgtaagatttatgagggcagaaaacttttccatcttgtccaccagtgtttctcaggcacttagagaactgtgtggcctaagagggattgattgtgtactcttacattattctttttcatttattatttcatttgtttcttataaccttataaggcataagtgctattctgtaggtgaggagacgaagacatacagaggttaaataatgtacccaaagctatattgctctagtagttggttatttagtgatttttttttttggctctgtaaatttgaggccatttttcttcagaacattcccttttccccagcatctttatggtacctggctatgcacttgcttttgctcataagcctaggttttgtctggtcagtcagtgaacataaataaggaatctgctaaccaatcaacaaggaggaagggagaaatcagtgaaaatcgtcactaatgttgaagataataaacattttggacaatgactgatgttttatgaagagcttttcataggaattcttatttagttattctcatgttacatgatggggaaactaatctcagagttgcaaatgttaagtgccaaaggcaacacagccaaaagtctatagctggtgcattagtccgttttcacgctgctgataaagacatacccgagactgggtaatttataaagaaaaagcggtttaatggactcacagttccacgtgtctggagaggcctcataatcatggcagaaggcaaaaggcacatcttacatggctgcaggcaagagagaatgagcgccaagcaaaaagggaatcccttataaaaccatcagatctcatgagatgtattcacaaccacgagaacagtatggggcaaaccacccgtatgattcagttttctcccaccaagtccctcccacaacatgtgggaattatgggagctacaattcaagatgagatttgggcgggggacgcagccaaatgatatcagctcgtgagtgagcatcagacctggggttcacatcctcgtatctttgcattctttcccatccattgtattgtgggaagagcagatagttctccccattcccactcttctttgttgtgtgtgtgtccactgttgatgagaatgtcactctttgttattttcaagtttttttagtcactgagctttcccatgattttcataggtcattggaattttgtattgttttatgaaatatacactgaaataagatccttggctacaattacagttttgtataatttagagagcacgtaggcaccattttcttgcccaagaatggggatagcaattcttttactttctaccacataatgtagctgtaggatgaaatcctgtagctgaagtttctcaactccagcccattgatattttgggccaggtgattgtttgttgcaggagggtgtcctgcgcattataggaagttcagcagctaccatggcctctaccctgtagcaccacccgagttgtgataatcaaaaatgttttcaggcattatcattttttttttggcttccaggggatgtaaaattgcccatggttgagaacctccggattaaattaagataataaatgtgaaaatgtacattttaagacaattttccaattcaaggtgttattaggatgagatttaagaacaatagaaaaaatcattgtggcagatgaggtaagcagcagaagggaaaacagggtatagacattaaggactagagttggctgtctcctattatagtcttgtgaaagctcactcatacagattcctgctataaatttcttgcttttgtatttttccaagcaaatatttaatacaatgttgcctgctaatagaacttcccattacagatttaagttttcttttcttttcttttctttttattttatttatttattttttttttgagacaagagtctcgctctctgtcatccaggctggagtgcagtggtgtgatctcggctcactgtaacctctgcctcccagttcccagtgattctcctgcatcagcctcctgagtagctgggattacaggtgcccaccgccacgcttggctaaatttttgcattttttaagtagagacgaggtttcaccatgttggccaggctggtctcaaagtccttgcctcaagtgatctgcctgcctcggcctcccaaagtgctgtgattacaggtgtgagacactgcagccggcctaagttttcatttctttatgaaatactgtgtagcatattcactaccatatgatgaataattaaaactaaattgcaattgtcaaaataaatgaacacatcacatttggaggtagaaaaattcctaatttttttttcccacgtagtttattgcatactattcttatttgtggtatttggtgttatgtagttactcaaagttgttacagcatttatactatatttgttttgttgaattgaaatcatagaacctgccaattaaatttaaaacaatgtcatacacgttggtttctctattacttacagagtaaaattctcaaagccccatgaggcatccttgtcttaatggcatggatatgttactgcatgtgctcttattgtccagccagctggtattcatatataagattttattaaataacatcttacacattatttatgtgataggctttggtgatggggctttgagaaagctgtccagaagagagatgtgagcattctctatgttaataactttctactattttattttaatgtaacttgctacatttgccatctgggatagaagcttctgcatcaaccattaactatcaacaccaactattccaggctgcagaatttcagtttgaaacggttctaaaattctatggaatagtgaaggcccgcttgcttcattgtgctttcctttaagtggagtattgcccagatgtggaagttagatgtggaattttcagacagaactgtttaccttgagaatggctgggcaccttccatttgtactactttttattattgtcagaactgatcaaataaatctgcccgagtatctgtgtgtgggatgcatgttgaaagcgattttattgttgcccaataagtccccaaatgctgtcgtcttttgctttccctctcccatcttaagtgcctttttgcaacttgcctcacaaatcacattgtctctacttattacccaggcttttctccagctggtaaaatggatttttttttcctcagccagattcagagtttgccctgttcttattccctgtatgtttcccttcacttttaatgtgaaaattgcaaatatatttctaaacccttctgcacaacactttccatttatggaaaactcacactatataaagtaacgagaggagatatctaaaatgtgtcttccattttctgctctgtatctccaactggaccaatttttccagataatttctcctttctttccaactttatctgcatcgtagaattcagagaactgaaagcatttcttcctttctttattttttttcatattctttctctactgcagacttcgctaactgatgaaacactgccagagcccacttggactgtttcgcaactttacttaagggaataaaagctctcatgctgaggtaaggcaaacagtccatgtaggttctcactaaaaagaagagtggattttataagctcgggcctgtcttataatctctctgtgtcttgttcttgtatgtaccttgataatttactatctgtcctttttctgcccagtggatttttgaggttcacaaatgtgagatacacaaagatgtgatatacacttgctgttccgtgtttttttttttttgcaaatatgcattttccctccagaactgttactggtaactatcctgagactcaagatgactttaaataacacttttttaaatactatacttagttagggttagacttggctgcaagaaacagaaaattcataagatcaggagcttaaatgagatacaactatatttttctctttgaattaaaacttgagataggcattccaaagctactgtagtgttccatgatgtcagggatccaggatttgtcagacatagcttttgtcctcatgattgcagatggagcataaggacaatgtgttatagtcacattccaagcagaatgtgaaaaggtacaattatttccttgtaaggaaagttcccagtagttgtggtacaactgtgctggttaattctatggatcggtgcttagtcagagggccatgtgtggctgcaaaaaaggctggaagatacgatacagtcctttttcttgtggccatgtgtccagctaaaatttatgtcctctaagaagagaaaaattagcagtattttgctctcaaacattaattttaatatatcctatattttaaaacactgttgctgggtagattgtgaactacatgtgggcaaggactgtgtataataaaaaatattatgttgtcagctcttaacggtgtcagcaaaataatgaataaatattcattgaaaatgtacatggagagatggtatttttatcatgtgaaatatgactcaaaatgagactgattttttacattttaaaacaaatgcacccaaccattgtttattcattcagtaatcactgagcgtatataccgattcattaaagtatcatttttctttctttaattaaaaatcttaaattgatatataatagttttacatattcttggagtgcatatgatattttgatatctgtatttaatgtagtaatgatcaaattagagtaactgggatacctattacctcaaacatttattttttctttgtgttgggaatactgcaaatcttctcttctagcgattttcaaatagacaataaattattgttaattataatttccctattgtagagtcaaatattagaacttatttcttctatctgactatatttttgtgccctttaaccaacttctcttcatctgcctctcccttcctttccaagcctctggtaaccatcatcctactctctatctccctgaaatctacttttttagtttttgtatataagtgaaaatatgtgttgtctttttgtgcctggcttattttacttaacataatgacctccagttgagcaaatgacagaatttcattctgttttatggccaaataatattccattgtgtgtagctataccacattttatctatccattcatttcttgatggacacaaagagtaattccatatcttggctattatgaatagtgctgcagtaagcacggcagtgcagatatctcttccatatactgattttctttcttttggatatacacctagcagtgacattgctggatcatatggtaattctatttgtagttttttgaggaaactccttacttttttccatactggctgtgctacttttacattttcacaaacagtgtataagctttcccctttctctgcattcttgccagcatgtgttattttttgtctttttgataatagctgttctaagtggggtgaggttatttctcactgtgttttttacttgtacttttcttgatggttagtgatattgaaaattttgtaatatacccattggccatttgtttgtcttcttttaaaaaatgtctatttgggtcctttgcctattttttaatgacattattggtttttgctattgagttgtttgggtttctcatgtattctggtgattaatctcttttcatatggaaagtttgcaaatattttctcccattttgtaagttatctcttcactttgttaattgtttgcagtgcagaagcttaaaaagcttaatgtagcttcatgcaatccaatttgtctattgttattttttttgtttttgttgcctgtgcttttgaggccttaccccaaaaatcttttttgagaccaatgttctgtatcatttcctctggtagtttcatagtttcaggtcttacatttaagtgtttaatccattttgagttaattttttatatggtgaaagatgagaatctagtttcattctcctgtatatagttttcccaacactattttttaaatttatttttcatttcaataggttttgggggaacaggtggtattttgttacatgaataagttctttagtgttgatttctgagattttggtgcccccatcacccaggcagtgtacaatatgtccaatgtgtaatctttcatccctcacgccactcgtactctttcccctgagtccccaaagtccattgtatcattcttatgcctttgcgcccccatagcttagctctcacttatgagtgagaacataccatgtttggttttccatttctgagttacttcacatagaataatagtctccatttccatccagattgctgtgaatgcaattatttcgttcctttttatggttaagtagtatcccatggtgtatgtaacatattttctttatccacttattgattgataagcatttgggctggttccatatttttgcaattggacattgtatcagcaccatttttaaatgagactacatgcttttggagctttttctaaaaatgagttggctgtaagtacatggatttatttctcagttctctgttttgttccattggtccatttatctgtttttatgccagtatcatgtggtttgtgttactatgactttgtaatataatttgaaatcacatagtatgatgcctctgcctccagctttattctttttgctcagaattgctttaattattcaaggtcttttgcgattctatagaaattttaggattgtatttttcatttttgtaaaggatgtcattggtattttgatgaggattgcaatcagtctatagattgctttggatagtataaatattttagcaatattaattcttctaattcatgaacatgggatatttcttcatttttaatgttcttttccatttccttcatcagtgttttatatatatatatttttttttgtggagatcttccatgtctttggttaaatggattcctagaattttttttgtagctattgtaaataggattgctttcttgatttctttttcaggttgatctctgctagtgtactgaaacactactgatttttgtatgttgattttgtattctgcaactttattgaatttgtgtatcagatttaagagtttttcgtggagtctttagatttcctaaaataaaaaatcgtatcatctgaaaacaagaataatttcacttgcttttcaatttgtatgccttttctttctttttctttcctaacagctctgactaggattgccagtactatggtgaatggaagtggtgaatatgggcatctttgtcttgttctagatcttactgggaaggctttcaattttaccccattcagtatgatgttagctgtgagtttgtcatatatgaccttaatcacgttgaggaatgttccttctatacccattttgttgacagttttcatcatgagggctgttgaattttatttcatgcacaagtgttgtttttcttatagtgacttctttaaccatttatcaagtcatgttttggatttctccttaaaaatgagtctcagacttaaggttcaaaacacctatggaaataattctctttacgactaatttttctctttaagcctacttttcttcatttctcagagaagttatcttgctctgataactttttaactcttcctaaaaatcaaatctccccccaacaagatggagatttggtcctgctgggggatttttaagtaagggctgttagctgtgattgaggtgcctgtatatatgagacaaggagccttaagggactaggatcaaattaattaaaagtcacatttattgagccctgccattgaagaatttataatgtcttctatgcaaaccaattcattggtaaggaacagcattgctattctcagcattttggaaataccacaatgttggagtcgtctcagaaggatctctgaagagttctgggaaggtgacagtcaacagcagaatagcagctgccaccacagtcaagcagttggtttgcttggcttggaagttttagacatcaaaggagtatggcttcttcaatactaaaaccagtgacaaaattgcaaaagttatttttattcctcttcaaatatgagcaaacattactgtgattcagcttatttttatataatgttacagggaatcaaattaagaattaaatgcattttttggcatagttatgtcttgtaaagaaagaaagatggtgccaggggaattttcctttcaaatatgtaaagaacttctaatgagtgaacctttcctgtgtcggaaagatagcattcacctcctttcctggcttctgtgccaacttacgattgtggtgtgtagaaatttagtgtcagccactgaaagaactatttcctaagatgatactgctttttactcaaggaataagtaggttccctttgaattgacctgtgtgtgtttggaaaacaagcttaaatatctcctcttctcataggaagaacactatttcaaagagccattttctttcctaacaaagaaattcatactgcagaaaaatcagcaatttcacagctggtttttgaaatcctgaaatgatgtatacaaatcaaagcaggagagattcatttggaatgaaaggaatatttgaattgcatcccagtttcgaataggatattgtttcacggttctacagtattataaacatgtcatgtctgttatacatgacaatcatatctcatctgtgactcatgaactttataagaaagtgacaatttgaaagcatagaattgcaggattggatggaacgatatcttctaagttatttccactccttttcccatttttggttgaccatgctaattcccctctaaaacattcttctgtagctacttgaaaacacccattgcttcttaaagtaacctattgtcaaagaatattggattttcttatgtacattgaaaaaatgacactttattggttttgattctaccaccaagagtcacagggaactttctatcttttcatcatatatataacaggcttttcatcttatatgtaacagtccttaaatattttcatattgtaataatttcctatggaacctgttgacttttacgctagagttatagtgatggaggtaatgagaagtgatcatattctggatatatggcagcagtagacagaaggtgtggttcataggaattgatcatggaatggatgtgggctgtgagaaagagcagtcaatgtttttgacctgaagatgttttactaacatatgttaagcatttactatctgctcaatatactttgctaggcattgtagcacaattaaatgtgcatttgcatagctgttcgatgatacaggtaggactattctctaagactaagagaacattagtcaggcctcttatggtgagggaggggttccctttctttccattctcatgctttgacttgagagagcaagcctatatgttattatggatcagaattgagatttcatgctcagttttaagtctaaaaatatgcttttcaatatctagtatttacatgcgtgtgacttctcaggaattataacgagagcctgaaaaattaccaggggcaacattttcagtccggagatgttataccccagttactgccactaaattttaagctccttgggagcaggaatttgattcttttattatattaatagtatctgttacataatattaactcagtaaatgcagggtatgctattgtaaaactatagtctcagtctctgtaagtggattttttaggatagactaggtcctagttaatgtgatatatctctatttctgtctatctatctgtctacctacctacctatgtatcatctatttatctgtcaatcaagagaagaaaataaagaagcactcttggagaatcaaaattttttataacatggtatgcaactcccttacgttctttatcagccacctgcatgcaaacagcattatgtctgaagttaaaacatgtaagatatatgagagtggaatccttggtgcatttcactcttgaactcttgtctatggagtaagtagcctgggggtagtttctcctcctttttatatatgtggggagaaggaattaggtggctgattatcttgtgctaaataggtttctctgccgatccacaaggtggcagggagtccttagtgccactatgacagattaaccaaataggcatctgtcgaaatgtctgatgcattagttgcactgcctgtaaaagagatgggcctccttgagaaataaatccacactgaatttcaaatgtggttgtgtccccaaaattagcaacgttttcaaaggtgtacccttcaaaggagagcagaaataaactgtaccttaaaagaactagtgctcagaggcctttgtttaatcaatggttagtttggtggtgattgcacaaattcactacattaaatttaatcagggatgtttctggtatgtgggtggcatgcttactgattaattcatttatattcttgaaataacatatgttctcctggatgaatttccacagtttggtaattccacagcatgcatttcagcatctctaaatggctgttttgttcactgtcccagagcctaagacatgctgggtgctgggtactgattagtttaccagactaagaatgacagacaggaaatggcaccattttaatctctcagaagaacatcagaggaatcatttcggtggctgtaaatacttcaggattttgatgtcaccttttcaagttgctttaagaaatcacttaggaatggtttgggagaccatgatacaatgaggtcccgcaaagaattacacctttctttgtcagggttctgaaattgattaagtataactatgtccgtgatgtaatcgattacattaaaactatcattttggagaaaagagacctgatggattacagagtctctacccttatttataaaaaacgatgaaatgaaactcagtagttcattgacttttgtagatggaaagatagtttgtagtagagctttgcattcaggactagtagttgccaccaccccccgcccatcccctattatagccagtttgtttgtttgtttgtttatttatttatttatttatttatttatttatttatttattttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttatttatttactttaacttttattttaggttcaacgacatatatacaggtttgttatataggtaaattagtgtcatgggggtttggtgtacagattattttgtcacccaggtactaagcctagtacctgatagccagtttaaagtgtgtacattggggaagggggggaatgaggttgttcttagacagttagaggcacagagggtatatatatatatgggattgccttatgttaatacatcacttggctttaagtgtgggaatggacaggagtacttgttatgacctgtggggccctactttccttcattctcagagagattttgcaaattgcctaaaatatctgttaatatgctctgtggctacatgcttacagacatgatgacaaggaggggggaaaatattgttcattgttgtcattttctagctggaaccatgagatttgcttaaggaagactgaaggctagtgtgacagaaaatggagctcaggaggacccagaataaattacattcctttggagggtcctgagaggggcaggccatggcttagttccttctattccactcatttcttacagttcagctgcctcccgatgtgcagttgtttagtatgcaaatcaataatcattacctatgtgaagtgttagttcacaggcgtgcaggctgtggtcagttggtacctgttccctcctaaagaactatctctgaagttgaacatctctgtttttctttgtataaatctgaatattaattagaccactgcttattaacttagggacctctctgcttttggtgacagtagcaggcagaatatagatggtagaaaacgaaatatcatgctgtttctgtaaacggtttggtgtctccatataataaaactctttagaattaactgcctccagaaacagggacaaatgtgatgtcctttctctgccccttgaattaaataacaaaatgaacagcagatcattttgatgttgctactccataaagatcattttgttattgttactaggagagagtggagtgtaatggaaagaatacatgtttacagctgggctgtaatcttggatcttctgaaaagtaagaatatgttcttgaaggaacctcaaattttgtgaatgtgcttattattttaaagataattacatggattcaatttctgtctccgtagtaacctgctgtattatctttctctagctatataatctctctttgcctccatttcttcatttgttaaatagggataataatagcacctatatcataggtttattataaaaaatgaaatggattcacatttttaatgttctatgtaattacttatcattgttgttttaatagggaaagtattggttatataaatagccaagaaaacagccaactgagacttttcttcctagattaccttggttatatcagtgcttctgggtgtggtcactgatattctacagcagaaacagctagtggggtccccaactaaagaatgtatcttattggaggctaagaattatgaggcaactatctctgacttgagaaccctaaccttatattgacatctgagatttattcatcaataaacacctttttgtaatccagaatcatgttatgtcattactttctatatcagaatttaaatgttaagggaccaagacattatgcaatgaatactaaaatgttactaaaatcatgtgttgtgaagaatatttggaaatatggaaacatgttcacaagatgttaagtaaaaaaacaggttagcaggttgtaaaacagtatttcagtatgattctaaattgcaatcattaaataattttataatcatgaaaaatgttattaaaatattataatcctgtgataaattctaatgagtactttcttgatttggctttaacattttccaaaattaaaattacaagttttttttctgattataacagtaatacagcttactactgtagctattacaagcaaaatagaaaattaggtaaagatgattaaaatcatccacaatcccagtttcttaaaatggccttactaagatttttaacaaaaatttactccacatatttatttatgaatttttatatgcaccatttctctaattttcctaaatggagtttataatatctacctgttttcactcaataatatattgaactatatgttgaccctcatcattgtcccaaagtttaaagtcattgaatagagatacagcaatcacttactgatggagatgtgtagtttggttgtcttacaatttgtacattaaagttatactatgataaagatctttgtgcataccaatttaccctaccaaaagatatgagaatatttccagttgaattttaaaatgaaaacctcattattcttttaacttactctcatttgattattgaggtggagtatttttccataggcgtctttgagcccctcaacttgacaattgtattgacaattattcactgtatgattatcgtgattattgcaattaagtgattacttatggtttctcatttattggaaggagcattgtaagggtagcagaaacactacagagcctttttttttttatttaaccactctcttgccctggacatgaggtggtgattggactctcagatgctgcttttgtaatatcgcatggtcaaatcaagccctatcaaagtgccctgtcatgtcctttcatatctccttagggttaagtatgtccccaaagccctgcgtcttgaggtaggcatgggaattatcttcaaaaatatcaacataggatataactttctctcttagattagctaagcttagaagaaaaatttctttgtggtcaaatgtttctgccatattaaaatctacaagtcaggtggtgaccagattttgtgatgccatccaaaaggttttagtacaaatttttcttaaaaatgcagtaagtaattgtaaactgtgatacttttaaattatctgcaagattattccatgaccatttttaaaatagatggtttttctgttgtggtcttagttgtcattttatagttgaccccacgtgtaacttttcgaagactctcaggattcccttcagtcctattctgtgtatctatctagtcattgtcccagtgaaatgataaaaggcccaactcagcttgttttgcaatgtgggcaacaaacatctcaataggatgtgtctcttccagttgtttttcttgtactattgatgtcttatggggagatatttaacttcacttcttggtcttattcgtagcaacttccatgactgatgagccagttgaattagtctttgggatagtcactaagtagatgggaacaggattttcttggttggaagtccatttcttgaatattcaagtttgtttgtcctagaaatttaattgactgagcctgcctagtaaaggaaatctttgtcatgccagtgtgaagttctgcttcccactttactattttcctcttaatgcagtactaatatatgttgaaccaaaaacaaaaacctgggcttatagcataacacacctggtattaaattgtggtaccaccatttgttatcctggttagttaacaactttctgaaaataaaataaggataataatatctatcttaatgtatctttttttcttatgaggtatctaagatagaagaatttctttttctttgccttcgcttaatagaggttagcattattttattttatataaacatagaaataaacatctgctggaaactcatttgagagaaaacaacccatgttggatcttagggaggtagatacacttttccattctttcttcaatctacagaggttcatgtcatacccacatcttcatctaaaaatcaaggaatgaggctggataccgtggctcacgcttgtaatcccagcactttgcgaggccgaggcagacaaatcacttgagctcaggagctcaaaaccagcctgtccaacatggtgaaaacctgtctctactaaaaataaaaaaattagccaggtgtggtggtgggtgcgtgtaatctcagctactcgggagactgaggcaggagaatcacttgaacccaggaggcggaggttgcagggagccaagattgcaccactgcactccagcctggacgacagagagagactccatcaaaaacaaacaaacaaacaaacaaacaaacaacccaggaatcattctagacattatttgtttctcaaatctgtaattgttttaggatctatgtttgttttcttttcaccaaaactaaagaaacactgttccttatttgctttttttttcctcagtctggctacttacttttctccctcatagacaaatgctaacaaccaatgaatcaccatatttctcctttattaaagctgtctccaatggcattctcagcaagttaaaatgtcaagtatatgggcctttaagaaaggtttcaaaagatatccctggggagggagggaagagaaatttgaggagggaggagggaagccatgtgacctgagaagcaggaattctgtacataaatactgaagtttactgtcaagcttccgagtaaaaatgttaaatatttgcagtgtccacaacccatgtccctgtgataaggctggttaattcctagaacataatgctaggaattcaagaatggggatcatatcctgagtactgatgatccatcttgatactgtgtcaaagggcacaggatgaggaatggaagggtttggagagtgagaataaattactgcaaatccaaacatctgactggataaactactccaagtggatatcatttattattcactccatagaaagattagaatgtacaccctagggagattaaggtaagagtaagagagatgtctaaacattttatgtgtccatcatctacgttgcctgtttatcagagtctgtcactataatgtttactgctgtaagtggttaattatgaatatatcagctgaatgctttcatgtcagttgagctgtgcagttgccacagtgagcactcttttcatgtggacttttggataaaccagcgtttagagattgtgttttataaattatatgaccaaattccaataccacatggagaatacgtgatttatgtgctaattggatcatgtccattagacatcctcataactatcttttatcggcactacagtttttatttactaaaacatagtcacatgaaagtttcctataatagtattctacactttctattctctgactcttaggaatcactactccttctgaactcctttagcaatgaatttcacaattatatattattaatgtgaaattcacaattatatattatatacatttaagtatatgcagtgagtttcacaattacatgttctttcatgtgtttatttttctcatcaaaaaattaaatcttggccaggcgcggtgggtaacacctgtaatcccagcactttggcaggctgaggcgggcggatcatgaggtcaggcatttgagaccagcctggccaacatgatgaaaccccgtttctactgaaaatacaaaaattagccgggcgtggtggtgtgtgcctgtaatcccagctactcaggaagctgagtcaggagaatcacgtgaacctgggaggtataggttgcagtgagccgagattgtgccactgcactccagtctaggtgacagagccagactctgtctcaaaaaaaaaaaaaaaaaacaaaaaaaaatattaaatcttgatttgaaagatttgaaatatcaggtgagtataaaatcattggtaattctaacaactgaaattaataatttcaaaaatattgctttttgtatgtctataaacttttatatattgaaaaaacgtatatatgcaaatatgttgaattcatgtcatatctttttaacattatctgcattataattttgaatatctttttgcttaattaattaatttatttttattatttttttttgagacagagtctcactctgctgcccaggctggagtacagtggcaccatcttggctcactgcaacctctgcctctcaggttcaagtgattctcctgcctcagcctcccgagtaggtaggattacaggtgcaagccactgtgctcagctatttttttgtatttttagcagagagagggtttcaccacgttggccaggctggtcttgaactcctggcctcaagtgatccacctgcctctgcctcccaaagtgctgggattacaggcgtgagccactgcggcaggcttctttgcttgatttatgatcttttaaaaaatttgtcatgctgggtcaattaagtggtaggtatttagaaagtaagactcttctattttttaggatctctgtggcatagtgcattgcaagtagttctcaataaatagcttttgttgtaaactaacacactggttactttctaaagtcatttgctcttttaaaatccctttggtatactaatctatactatatcactatacttgtagaccaagggatttgtctggccaacatggtgaaaccccgtctctactaaaaatacaaaaattagatgggcgtggtggcgcgtgcttgtgatcccagctactcaggaggctgaggcaagataatcgcttgaacctgggaggcaaaggttgcagtgagccgagatcgctccactgcactccagcctgggcgagctactgcactccagccaagggtttggtctacaaatatagtgatatagtatagattaattcagttgctttaaaaaaatccatatgccacaggatggctcaggatatcaatctatatcttagaaaaattattatacaaataaataggcaacaagattgagaaaaactggtatatttggtaaaaatacaccaaaaaagcaagagaggaggagggagatatgtgttttagaacccacacattttcaccaggtgaattttaaaggctataagagttcataaaatcttagcatcctgagtcatttgagagtctgataaacatcatttaaatacgtaatttaattgtttctcttttcttgttagagaaaggtggtgcaaacttattcctggaagacggtcagccatattaataatgagcaaaatgcctattgagttggttttttaaatactaagaaaatgacttttgaagttaaaacacatgctaactgttgcttagttttaaatatatatatatggagtggaacaaaagttcccactcaacagcttactgaaaaatacaaaaaggaatgcagttttcagcaggttctatttgccataaaacattttcttttcttaccattgttttatttttttctttctggtctccccctcttgccaacgttcacagctggacatctttgtccatctttcaggtactttgtgttgcatatccgtacgtgaaacacatatatgcataactattcaggtttccctcctgtctccattgttggcagaattctcattcaagttaacattaatatacttttttgctcttctcttcctcctggtttgtccttttgtcacttggaaaatattgatttccctccattgtaggtgagatgcacctacatggctcatttgtgcttacttccttcttgtttggagactcagcaagttcagcacaatgctatttattgaatttatctgtcaatttcttcttccttgcatggctgactaattcagtggaatcagcacaataccagaagcacagaggataatggcttaaattttttttttcgcagaaaattgtaaatcaaaagtagagactaaatttgaggaccaatcccttcagaaggttgcaacttgtaaagtgtgtgcaggactgtctaggtgaacatggcaacagatatgattttctaatggggcacttctcagcttttcattaaatgtctaagaaatacacagaaagacatgaattggcagcaggattgtgaaataaaaatgagaggagcctctaacataggcaaaaactttcctccaaacagacaaacaaaagcgtataatcaatgaagaaataaaaatcagaataacctcattttcttcacagtacaaaatactaaaaaatcaacagagttattttcatgaatggcttagtctttggaattggctttggacatgcattcctacttcacacatcccagtgaacctcagcacattagctggttactgagaaggtaggaaagtaaactgacctttaccttttgtgaactgggtgctacttactaggatcttactggtctctttctgccaaggtcagctcctcttgtgttacaacagagaaacgactaatctcagaatgtaacatgttttagataagtggtatggagaagcagtcatgcttagttgttgaaagagaagtatacagtatgcacaagtgtatacttttgtaagtttttatgctgttcaaagaagaactttaagatactattacagcatagtcattaagagaaaagatgttaaatagacaagatgcttttgaattgcaagacccctgtgcctaatcctgaaaaagttttctaacttctttgtgccttagtttcctcatttgtaaaatggccattaaacacttcataatattactgtgaggattaaaaaagtaagaactaagtccagtgtttggtaactgtagtaagccctagatggatgattgtcactactgttatttaccctaaataaattcaatatttatctttagttattattataccacactgttactaagttaggcttagaaggaaatgactccctgttagctttgaaggttgagctacaagatcatgcccatcaagttaaaattaaggttttgacctgacaattgaaggtgcaagcctagagagattaccttccacataagcttaatacctggcctaagtggcttgctcacgttatctaagtagaaacaaactgaaacaaacaaaactaataatcaaaactaataaaaacatccaaataaataaaattattgattcaggcaaggaataaggattaataaatttgataatgaggggctggataattgtataatgtcaaggtggaatcacacgtgtaactttctaatcaaagaaaaaaaacacacactggagagatcctactatttccatcctattccagtagtcagtcagttgttatatgccctgggatataatgcaagatataatgagcaactttcacaatgtagtctagtcaaaaaagttttaccaacatcagatcattaggagatacaggagatagaagaacaagggagacatcatcacatggatgcaatcagacaaatgacacgtgcgagacattctgtgaaacagcagacctggtctcttcaacaagtcactgtctggaaaaaggactgaactatattaagaatgactgaagaaacagaatcagatgcaatgattggtcttgaattagatacttattttgtcaaaccagatgaaaaggcatttttgacaggattgcctgtttttgtaacccaaaatatgcattgaaaaaaataagcaagacttttgttaaaatatctttagacagaattttggtatatatatatgatatatatgtgattatatctacatatatctatatatatattctgtctaaaaattctcacaattctgtgtaaagatattttagacagaattaggagatatctgtatctagctctagatatagctaaatatatattcctttatatatctataaatctatatatctagctatatatatttagatatatcttgctctagatatatatctagctcttatatatagagagagagatagatatagagctaggtatagatatataaaggaatatatatctatatagtatgtttatgacctacaagtattcttttttgatcaggttttcttgaacatcagatatatgtatataccagaccattcaacatgcatttatttttttatttttatctttaaatagagacagggttttctcatgttgcccaggctggtctcaaactcgtgggctcaagtgattcacctgcctcagcctcccaaagtgctgggattacaggcgtgagccactgcacccagtatcaacaggcatttataagcataggtataatctagtgctcttgattgattaaaagtatattttgagaattgtttattgtgattgcttgaaaggtgattattataaaaatgagtaaaataatgaatcactactcccttttttgtttcttattttgtttgtttcttccttttgtactcaagtaacaaaaatcttaatttagctctgaggatacaaatgaagagtaatgtttcttgcccctggtcccacagttagtgacagacagtcactaaaaattgaaatgcagacagtccaatttcagaaaccatgctcttgaccaatacattgaagggtctttagctattagctgcctataaaatatgtggtcataaccgtagagaacacagcaaaataccacaataaaaaaggataaatgaaacttcactatttttcatggaaaaacccaacttgtattgcctgcttcctttgtcagctttgagaacttcagtatgaagttttgtacctatagctccagctcctgaaaaaattgttccaaaagcctcaacaccagttaaattaagttcctgacagaagttggaaacattatgagaatgacacacatggtttttgttcagatcatctggggaatgcacgtcacactggcatcaacctccaacagagccttgggatgacagaagcagccgttcggaggaggcctctccttgctctgttagtgaaaagttgagatttggatggtatttttcacactcttgacagtttatgacacgctgatgggatgaaacagagagactgcatactaaaagttggctgtgacctaacaagcaaagttacacaagtcatccctggtcacataagaggtttcacctcctcatttctaaaagctaattattactagctttttgtgattaccagatatacctcttccattttttatacctcctactctcttaacatggacagcattgttgaactcaggatctgaagtcagacagcattgtcttctttgagcctcaatctgcttgtcaatgaagtagggatgatgacaattctttccatatagtgtagttgtgagcatgataaaatgcctagtacagggactgtctagtaactcctaaccacaactattatgcttgttagtccccatggcctatttattttaagcccaaagcatcttctggagctaagcactgtaatgcccttgaagtgttttttaatctcttcagttctgtctactgcacgttgtggtcttacactgctcctggccactgttgagttattcctaaaggaatacagcaatttcagaggccttctgaagctccctgtcatgcctggcaatgtcattatataccaactgatacgtttttacttttcccaattcttgacaaccttctatagtagtatttcacatatctgcttggaaaaaatatttgggtaacagcttttggtattgctaggtgttttcggttttcttcttacctttttgtttatcgtagtataattataggaattaattaatttgtcgaattgtgttatttctctgctcgtctagcatcatcttgctgtatggagataaagagcagttaattttgagtaatatactagaagtttggtattcgtgactctcatttttggtgaaccactctactgactcaaaaacaaagatttttatgtgctttgaaattttaataatcaggtaatgtctaacatttcacattttctccaatagccactcttttttgcttttatttttgcatataatcctgctccatttctaaaattgccctttgaaattttcttattttcctacacattccagtttattactatgtggaagctgataatatttatactttgttttctaggaggtcattgatataaaattttattttatggttgattttcttgtgaatgggtgttttacacaattttcaagtaattggcgtggattttatgaggccagtcaaatgtagcaaacattataaaattactgaaaatgtatcagtgatgacaaatatttaatgattggtttattttgattggtcgtagttccatttttctctaaggcatcttccttaaaataagcatatataaatgacctttaatgtatacagcatgcattttttcattctctagcaatgagagcaagcacataatgttgtgatcactgttagcccatctgtgttttaacatgctctccttagttttattctcctgtgttgttcatttagtatatggcctcattcttccacttttttttctgttttgatgaatagtttggataataatgactgacccaaggtgtgcaaatgatttaagcaaacaaagcaaaactattccactgtcttttgaaatgtaggcttcagggtatcttgaattgcattcaaaaagataaaactcttcatcagaattaaaaacatacgtttacacaaaatcatgtacacaagttcatagcagcattatttgtaatagccccaaagtagaaacaactcaaatgttcatcaactgataattcgattaaacaaaatctggcataaccataaatggaatattattcaggcataaaaaggaatgaagttctaatacgtgttacaagttggatgaactttgaaaatatgctaagtgaaagaagtcatatacaaaagacttgcaaggttctatgccttcatgtatatgaaatacccagaataggcaaatccatagaaacggaaagtagattagaggttcctaggagccaggtacagaggggaatggagagttattgcttaatgggtatggagtttctttagaggaaaaaattctggagtggtggtggctacacaattttgtgaaatatactaaaaaccattgaagtgtatgctttaaaaaggttaaatggtaaatgttacattacgtgaattttatctctaaaagcattttaagagaagacattataataaacagagagtacaaagatcagaagacaaaagaaattggtggaaattatttgacattatgaagagcattgtaagtctcaatttcagggagaattgaccataattgacaaaatattgcataaataatatcagggatgcatttggataagaaacacatattacaatcctttataatgttaacttagtatgtattccagtttccacaaatgcactccatctcccccaaagtataggcaagtagtccttgaaagttggaatggaaagattaagcaacattttcataaatatgtcactgaaacaggctcacaaagcagtacatgccatataatgggaactggggtatagaagagaggttaatcaatgctgtatagctaaactggaagtaaagagggatttcataagagaggttccctttaaacttgttttggaaggatacataggagttctccatagtgtggataatgagggaacaatatgagcagtaagaactttcatctaacctttaacttctttcttctatccagaaagggttagtcaattttgcattgagcaccatcacccattccctaaatacaattcaaacggcttacaatccttgtttttttggtttggtatgtaaggtttagttttcctccaacttctgcatttctcttcaagggaggccattaaaccctgtttttatttctaatctacaaaagctaaaaaagcatatttccctttatgaatttttcatatgctcatctgatgcttgtgtgctctctgcccctttgcctggcctgaaatctgcttcttacttatctagttcatctcttgctatttgccaatgcaaatgtgggctaaaaccagctgaaacagtaagggcatgttagcagagggaaaaaggaaaggaaaaagaggcaaatagagtaagtacccaaagaaggaaaaagagcagagatcatagatggctatatgaggttcaggcagaggaattaaagaaagtgaagaaatggttgggaagaaattagaatgatgcctgtagactggaagcagtgaaggaaacaacatcagaaattggggcaaaagttaagaataggaaataagcttttactttttaactgtgctgcaaggatgcaaaaccaattaaattatttgaaaatgtgctttattttaggccaatctatagtatacatatcaaaacttagcttgctctggtgttcaaggtggctttatactgtttggctatcctgtgtttattatgccattaatccttttaactggtctggaaggcaatttagttttaagtcagttacttttttgaaatgaatcttatttataccaaacttctcatgtttgcttgaatttaatcaaatttttatataaagtgtaatttcaaggaatttataatggagcatcaagggaggagttggttatgtaatcatacttttgtaattttctattgtggagaaatttatctgcttagttattgaaatcaaattcctgcaatagagctattaaaatgggctagcatcatctttgagaatgttccttcttaaaggtaatataaattatatccaacaggagagaaaaagttaacttatgaggtgagtagactaagagtcattaaaaaaatcttgaggaagatttttaataatatgtaaaatatttctgatgtggtagcataaatatatattataggacattattaatagtaaagtgatccaaaacatataccacagggagatgacttgaaaaaaatgcattaatgcttcatcagttgttatcttagggtagtgggtaataggatagtttttattctctctatatatatttttgccagattatctaataagatacgtttttattaataataaaaagagagacaaatgatacaaattttagaatgaggactgctcagtctgcataaaaattattttcttgcaacaaagatgcactatggaattcaaaaatggtggtaactattgtcaaacatgtagagattggagttcctaactgttgcaggaagatctaagataaagtactacaagatgagtaacaaatacatccttaaaagcccatttaaggagttcttaatcgcaaaaaatttgaataggatttaatttgatgaatggtctagttaaccaaaatagtttatctggttcagttactgttgataaatatatttaacgacattgcaattgcatattattcagccacaacataatttcattaatgactcattaaaattattgtgaaaaggaaacacttaagattgcattggagcattgggatacctcacagtttgattttttcttcttcctctccctgcacattttttacttcttatatttaagtattctgctatgattttaaaaactagctacaaaggggagataacaaaatgagagccttctcatattaaaaaatatcgtttcttctcctaccccttatttttcagtgtatgttcacattaagaaactagaaaaatctagataagcagagccaaggtaattagttttctgtaattcttacacgaagagatcatcactaatgtcattttggtattatttactgagatttgttttttctacacttaaataggcacataaatacatgattatgtatttctcacactgttttatggcctgtatttcacacttggttttataatatgaacatcttccatgtcagaaaatattattcttcattatactaatggccaaatattattccatttgtagatgtatgtacttatttaactaattttctgtctcttgaagatgaattcctgcagtggaattgctgaatcaaatatgtatatattttgatgctttacggcattaatacattttcccttaagaaagttgtatcaatttatacatctatcatcctcagttaggtacatccttgctgactttgggtggcttttttattctgtttcccatttttataagcaaaaatggtattatatcttctttaattctactggtaggttgaacttttaaacatttaactatactgtatttctcggatctcctgccgtgtgtgtgtgtgtgcatacaccccctgccccccccacaacatacacatacaaatacatatttggactttaaaaaacactatgaacttgaattttttggttgtgtatacaccagtttctaattgattagaaaaatgagaaattctcttttttttaagtatataggaactaaatcaaaatattgtgaaacctgaaaagaaaataccacaaccccaagcagaaagggcttagttagctttaaaaaaactacatggttgttaaacaaggcttgtcaagctattaaaaacaagagtaacataaaacttacaatttctaaataggaccactgtttctaaatatgttaagtggtgtttaagtcagttaaatcttacagccaaaatgttgtattaatgcatgagtgagatgcattatagatgacttgataataaagttatgtatgtttacaacagagcattttgttcttagaacatagtgggagcctgaagtcttgggattatccatgatcataattgaacatatgtttagtttactctgggcaccatattttcaaagggacataaatgaactagagaatgcttaaaatgttgggacatggttaatcatagtgtcacatgagaaacgtttgaagaaaccagggataaaaaaagccggaatgagttaagattcaagcatggcatcattatatacaaatgctagatgagctatcaatgcagatttcaggttttgattgtacccctgagatggattaagcgtttgtaggtagaagtatgaagaatctaaacagttttgtggagatattcgtagttagatcaaacattcccctaaaaatgttcagggcacattgtctcactggaactctttgttcagaaactgaacatttacttagcaaggcttgttgtagagatgattttatcatttgatggtagttgaactagctaagttttacactcattttcagccctgaaattaaaacaaacttgaacaactggaggaatttatgccattatacacattgtaactctagcatacaatgcgtgaaaaatatgctagtttttttcatagcacattttaaaactgaacatttgaaatgggctgtgtataaagataaatgaggctgggcacagtggtgcacgcctgttatcctaacactttgggaggccgaggtgggcagaatgcttgagctcagaagttccagaccagcctaggcaacttagtgagacctcatctctacaaaaatcaccaaaattagcagggcatggtggtgcacacctgtagtcccagctacttgagtgggctgaggtaggaaggtcactggtgcccgggagatcaaggctgcagtgagctgtgattgtgccactgcactttagcctggatgacagagtgagaccctgtctaaagaaaagaaggagaaggagaaggagaaggagaagaagaagaagaagaagaagaagaagaagaagaagaagaagaagaagaagaagaagaggaagaagaagaagaagaggaagaagaagaagaagaagaagaagaagaagaagaagaagaagaagaagaagaagaagaagaagaaggagaagaagaggaggaaggggaaggtgaggaggaagaggaagaagaagaaggctgatctgattgactttgtgaactatttatattcatctattgttgcttgtattacattgcaagaatacaaaactaataaaaatgtatgaacttattgtaaacttggtaaattgagaataaagatctcattttttttgtgttaactttataagaatctgtgagagccagaatgatttcagacactgatgacaattttaacagaaacataggcgtttcacaatgcagtgggaaaattaatagcagaattagaaaataaattagaatagatattagttgaaataatctgaaatgcatttgaaaggaaaataaggaacagagatttcttagtccatttgtgttgctataaaggaatgcctgagactaggtaatttacaagaaaagaagtttatttggtttacagttctgcaggttgtacaagaattatggtgctggcacctgcttctggtgagggcctcaggctgcttccactcattgtggaaggtgaaggggagccagtgtgtacagagatcacagggccagaaggaaggaagagagatagaggggaggtggcaggctctttttaacaaccatctcttgcaggaactaaaagaggtagaactcactcactaccatgaaaatggcactaagccatttttgaggtatctatctccctgacccaaatacttcccattaggcccctccttgcaacattgaggatcggattcaacatgagattttgaggagacagacatccaaactatagcaagaggaagttgctataaaaacagatcaaagaaattgggaaagattgcaacacactgagatccttaaacagtttccatttcaaatggaatagataaagccatactaagtataaaacaaaatataatgaaaatgtatgttatcaaataagtggaaggattgtaagaagaatatgaatctggaaatcagaatgaaagaaaacaatacaagttttgttttgttggtaggaaaatgttggctggaaaatgttaaataaagatataaattagagaaaagagggatgtttgtcttgaatgttcattcagtgacatagggaaggtggtgaaaagcaagaaattccaaggaatagagttaaatgaaggcattttatatgagtattaaagataggtagcgaaattcaaggtacacagaaccatcttaaggtctgaaaggccttaaaaataatccaatcccatacccagtgaatggagcttggccctatattcttgagaagtgcttgcttagtatagactcaaaagtacatttcttataaggctatacatttatagttttaaacagcttcccaatgcctatcatacattcgctttagaaatattttagaaatattattttaaaaagaaatattttagatgatttctaacatgaatgatggagtgataggtacagggaaggatgagagaccaggtcccctaaaacccagagagactaaatgtcatttgggacttttgcacagaaagaggagcatggatttgacctatgtttctcattgcatagagatatcctaggaagatttcaaaacttttgtatgtttagttttctcatctgtgaaatggcgataataatagtatctataagacagagtttctataaggattaaatggatagtatatgtgaagaccatatcatggtgcatggcacatttatgatgttcattaaacgttgctgttaatatatgagaagggctgaagacatctgctttaagtcagcatttattgaacacagttcaggggaggaagattggattacataagatggtcttcctgtcccttcaaatcaacttgggatttttttttactttgggcagctacctttcaaccttcagtgcttcccgcttccccgtataaatataagagaaaataagataatgaagaatgaactataaaacaatttagaggcttcttgcaactatatctggttttgatctctttctaattttattccacttactgcatttctaagaatagtcattgatgtgtaagttattacgatagtggctgaataacattaaaaatattttatcatgaagtagttctttctagacatttgatgattgaaaatttcatactacctctcggaaacttggaggcatagttttcagggttacagaatgttcattattagtatttagtattttttagattaaaattcccatcttagggtgtaccttctctgagccagtcattttcttagattttgaaacttttctacacctaacacgatggagtaacagggactggatttatctttctgcccaaaataacaacaaaaatgtgggaaaaaatgaaacaacagtttctagacagtaaacaataacaagcagcacagagcattgatcccagaaacaggggcaatgaaagagacaagcgttagaattgtcctggcttacatttcaaagagagcttccgggccataatgcaggaagggggaagccaggtggatcctggaaatatccagagtgattatgagaaactgatcaggcttgtcttggtatgttatgacttgaataacactgcactaattgtgttttatggaattgacattggaacattcatatctttacatttatacgtacaacacctgttaatgaagtacttagtaaggtctgtggttgcagttacaggggaaaatcattaacgatgatggtgaagcaagaaaggctggataaaaagagagaaagacgatacgtgagacctaaataagtgaaaaaatgaggggtccattcaagagaatgaaaaagttcagtttgaatgaaatcacaattgtcaaatcagagacatgatgaaagaactacaggtaagccaggctacacagggtcttagagcatcttaaagatttgtgtattgttgcgagggaacaggaagccattgaagagtttaagcagagtgtgagatcattgagtatatactgctggggtctttggatgctaactagagataaccattaaaattttctgacttaaatctgatgagaggaaaaaacttatttccctttcaacagaaacttcgggtctgaactttgtagagtttattgtggctaaaatgaccacgtttttcaaagaaaaatcgacactataggattttttaaaatgacatgtgaaagccttacattataaattaaatcaccatctcatattcagctgcattttttaaaagaatccaactatatatattgagtgtcttggtcactttggtcctgacttatactgtagctgtacttttgaataactgcatctgtccatggccactgagaatctagaccccatcactgcagatgtgatgatatttttgttattcttatttctttgcttggatttatgtaaatttttttacccttccagcctacctaactacattataatttttttggtatcagggagtatataaaggctgtgttcgtccccagtgctaagtacagaccctaggcattcaatacattcttgttcaaatgaatcttatggagaattccaacccatataggagaattctcactattcaagaatttatctccaaattttcagcatcatttaaaaatgacaaataaattttgacatgcaattagactagcagagtcaccctagttacaactggttcctatcctctccccctttagatatttgaagaaaataaagtatgttaaaagaactcaaaataaatttttaattatgatattatgattgatgattattgaatgcatgctagcttttttccctactgtttattctatatttcaccataggataatgctaatataaaattattaaaggattaattcactgaagtccttatgataaagtatttggggatccctaaaattcttctgagttttaagtggcttatttgtgttgatttgttttgaactataatattttattttattttattttatttattaactttttttgagatagagtctcgctctgttgtgcaggctagagggcgatggcaggatcttggctcactgcaacctccgcctcccaggttgaagagattttcctgcctctgcctcccgagtagctgggattacaggcattcgctaccatgcatgactaatttttttgtgttattagtggagatggggtttcaccatattggtcaggctggtctcgaactcctgacctcaggtgatccacccgcctcagcctcccaaagtgctgggattacaggcgtgagccaccgcgcctggcgaactataatattttaatgccattttttacagtaagtaaaatattaatccatcacataattaaccgttaaaatgtctcatgcccattccctgtctcatttgtaaaaagtggtacttgtattgtcacttctacggcacttatctgtcccacacattttggcaacagattatttttcttctggattcttctctaatagtgttatatttataagcttgtctcttgcacaacagaatgaacttcacaagggcattggcttttcttctatctcttagtgaataattgtcacttaggatttattgaaacacagtaccaaacatgtattaggtaccccactgatatttgttaacttgaataagttgaatatgacaactttgttttgctttgttttattgaatttttcaggattatttgtatgcaataaaatgctcatatctgaagtgtacaatgtgttaactttttgacagccattaactactactcagataaagatatagtatatcttcataattttccaaagttcttttatgtcccttttaggtagtagtctccactgtaccccaggttaccacttttctgactttttatcccttagagtatttttacttggtctagaatttcttataaatagaagcatatagtatatactcttctttgccttcttttgctcaacattttaatattcatacatattattctatctatcagtagtgtgatctttttcaattccagatagtattctacagatgaatatatcacaatttattccattcttttgttgatggacattttggatgttcccagtttgggactactataaataaaacagttatgaatatctgctgcaagtcttgttgtggacatatgcactcatttctataggagtaaaactgctgaatgataggttaagtatatgcacatattcattagaaactgccaagctcttcttcaaagtgattgtcacatttacactgttaccaacaatgcatggaggtttcatttgtgtccacattcccactaacatgcgtattgttattcttttgaccttcacgattcttgtgggtgtatagtgctattgcactgtggtttaacaagagttcttgaggactgttgattgcagatacctaattttaagagaagtatgtgtaaattgtgcatttttcaaacatatttttgtacaaaaagcagcaattactttgtctccctgtgcctttgctattcatggaaaaacgggaatattagtagtactatcttatactgtgaccctgaagagtaaatgagataaatttagcacagtgccagacacatagtaatcactttatataaaatgttaactattattgtgagtaaaggcaatatattgttttttcatcattgttagtattattgagaggcagaatggcatagtatttattgcctgtgttcaaatcctggctttaccacttactaactaatgactttaggcaagttacttaatttccctgtgtctcagtttcctcatctatacaatgggaataatgcagcacctgtttcataagattttgtgatactaaatgagtcaataggtttcttggcacataataaacaagataaatgtgttggctgttattattactaacagggtgctgttattactttatatctttcttacgagtatatctctttaaagtagcaatttatttaaatgttttcattttagcatattgatagaatattaattttaatccagcaatccagtttacctaaatattctccaaaataaaagttgaaactttttttttaagtgtaggcagttctcttggtattgggtttgtgtcaattatctcttgctgtgtcacaaaccccaaaactcagtggcctaaatcattggccactaatttagtgtacaattctggaggtcagcagttttgactgggctctgctgatgtttaccctggtcttgaatgcatggatggtcagctctgtttctagcagttgagttgcttcagttagtggaagcatttgaaccatacatcttatcagccagccagctttccctagcttgttcccatggtggtgaggcaggccaaactgtaaagagcaaagagcagaagcaaggtctctggaggcccagccttagctcttgtgcagtgttgcttccaccatgttttattcctagtgtaaatcataagatttagggacctgagaaacagacaaaacctattgatgtcaggagctgccaagttacattgcaaaggaaaggcagaagagttgtgactttttttttttttttactgaatacctcactcaagagcttgttaagaataggctgtctctggggtaggtgcggtggctcacgcctgtaatcccagcactctgggaggccaaagctggtggatcactcgagctgtgaagtttgagtccagcctggacaacatggcgaaacccagtctctgcaaaagcatacaaaaattgctgggcatggtggcagacacctgtaatccaagctactcgacaggctgagatgggaggatcgcttgagcctgggaggcagatgttgcagtgagccgagatcgtgccactgcaccacagcctgggtgacagtgagacctgtttcaaaaacaacaacaacaacaaaaaagaataggctgtctctaattctttctttttttaattattaatatactttaagttttagggtacatgtgcacaacgtgcaggtttgttacctatgtatacatgtgccatgttggtgtgctgcacccattaactcgtcatttagcattaggtatatctcctaatgctatccctcccctctcccccaaccccacaacagtccccggtgtgtgatgttccccttcctgtgtccacgtgttctcattgttcaattcccacctgtgagtgagaacatgcggtgttcagttttttgtccttgtgatagtttgctgagaatgatggtttccaatttcatccatgtccctacaaaggacatgaactcatcattttttatggctgcatagtattccatggtgtatatgtgccacattttcttaatccagtctatcattgatggacatttggtttggttccaagtctttgctattgtgaatagtgctgcaataaacatacatgggcttgtgtctttatagcagcatgatttgtaatcctttgggtatatacccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattgtaactggtgtgagatggtatctcattgtggttttgatttgcatttctctgatatccagtggtgatgagcattttttcatgtgttttttggctgcatgaatgtcttcttttgagaaatgtctgttcatatccttcgcccactttttgatggggttgtttgtttttttcttgtaaatttgttttagtttattctagattctggatattagtcctttgtcagatgagtaggttgcgaaaattttctcccattctataggttgcctgttcactctgatggtggtttcttttactgtgcagaggtctttagtttaattagatcccatttgtcagttttgtcttttgttgccattgcttttggtgttttagacatgaagtccttgcccatgcctatgtcctgaatcgtattgcctaggtttttttctagggtttttatgtttttaggtctaacatgtgagtctttaatccatcttgaattaatttttgaataaggtgtaaggaagggatccagtttcagctttctacatatgactagccagttttcccagcaccatttattaaatagggaatcctttccgcatttcttgtttttatcaggtttgtcaaagatcagatagttgtagatatgcagcattatttctgagggctctgttctgttccattgatctatatctctgttttggtaccagtaccatgctgttctggttactgtagccttgtagtatagtttgaagtcaggtagcgtgatgcctccaactttgttcttttggcttaggattgacttggcgatgcgggctcttttttggttccatatgaactttaaagtagttttttccagttctgtgaagaaagtcattggtagcttgatggggatggcgttgaatctataaattaccttgggcagtatggccattttcatgatattgattcttcctacccatgagcatggaatgttcttccatttgtttgtatctcttttatttcattgagcagtggtttgtagttctccttgaagaggtcctttacatcccttgtaagttggattcctaggtattttattctctttgaagcaatttaattatttcagtggaagttactaaagaacattgaagtttgttagaaaaaaagaggatgtcactgtaatataccataattgacaagtaataactatttgagtactaactggaggagaccaagcttaaatggttattcctgggaagaatgatttgtctcagggtgcgtagatacaaatgttaccaacccaccatgacaaagtttaggcaaatacaaagagcaacactaactttgatattgtatagaacaaaagggcacaagaagaataaaatggtccacagatattgcaggtgacatgtactatatgcaacaggtgtttgtttaggttatgttatcaccctttgctctgaaaaaaaaaaacaacaaaaaactataattccaatgaggtagaaaattggattgtaacagaaaactcacctttcagatgttcttgaaagatcttcaatgtagtattctaaaagttctattgaattattttaaaccatgttatttctattttcttctgaaaagaactaggtgacattaaagaagtctggatagaggaatggaaacaatttcaaaaagtctttcttcaggcctttgatcataggcattattttcaatttggatgaactggggtattctgactacctaagaagtctattgtcaaaatctgaatttattctgcaatataaattcagtttgggtactttaaatgtcaaccgtaatgtctttcaatcagtttattactgagatttttccagatttgatgtgtggtatcaaataacttacattatttgcaactatgagaatgcacagaaagcttcgtaatttacatctaaaaggaatgcaggacagatttggttttagttttattttaaaattttcatcagaaggaaatcatctgtatacatcatactgttgaatatttccaaatgatgttaaacattctgatgctttaacaattacattaaaaattacagaattgatttaagattgtgttaagaggttatgttgttgcttttgaaaacagtgagataagataaatcagattccatctcctcagtgctgcctatgctgacctgcctatataaaatagcaaatcccatacatcgtctgtctgatttcaccctgcccatttaatccccacgcattttagacttataaaatactgtatatttttcttacttgttatttttattttccgtctacctacaaataaatttgagcttcatgcgaccagaggtttttgattgttatgtgttttggtttgcttgtttttgtgtgttttgtttgtttgttttgttttgttttcttttgttttgtctgagacagagtctcactctgtcacccaagctggagtgcagtggcacaatcacagctcactgcagcctccacctccttgggctcaagcagtcctcccatctcagcctcctgagtagctgggaccagaggcacatgccaccacacctggctaattcttataggttttgctagagacagggtttcactatgttgcccaggctagtgtcgaactcctgagctctagcatcctgcctgccttggcctcccaaagggttgggttttcaggtgtgagccagcgtgcctggtcatctgttatgttaagtgaagaatacttagcagctggaagagtgcttggcacaaagtgaacactaggtagatgttggttgaatgaacaattaggttgataaatgaaggcatttaattaagaatgtaattagtagcaaatcacctttaaaaatatatctcattttatgtttaaaaataattacaaatgtataattttaacctcctcctttaaggttcttgtcgtcttgtcagtcgaattaaaatctagccttaacttttttcttgaaatttaacaggcttattttcacacctggcttttgttcttgtagttgtaattagtcagaattagtatattaatttttaaacacacactacctcatcttttgctctacttatcaaattatctaattaaaccttgaattttcagaaaatagtttcccaattgcattctgtgtatatcaaaatgcccttgaaaaaaatggaatttgaaaatttctttcttctgtcccccgactcttgcctctttcttagtctctccgtccatatatctctccttttctctcatacaatttaatagagaatgaatttccatctttggtacattcatattaaaaatctaatgccacatatgtggaggaaaaatcatatagctacatttcaaccaaaaaagtattgtgtatgaaatatatattctatagtttacttagtgaatgttattcctgaagactacaagtggcagcaaagaaattacgtggcatatatgtgtagattaagcatggaatgagtattgttttaaaattaacctattacctgtatggccatgatagtttttgtgaggagtaaattaatgcatatatgggagaaggctttgtaacatgtgaaacacttggtatatgagaatttgtattgaaatgattagacattaaagcatcttgttcataaaattttgataatcttcttttagccatttcttcaaagtcacttctatttttgtcaaatttcacctgtcggggggtttttagcttctgacctcagtattgtttcagtggctgagattaaacagcattctgacttgtacacagacaagtaactgtgctaatatccagtgaaattgaaaatggacaggaaatctttatacagctaaggaacaaataaatgataagagaattaatccagcattattgttcagaaaattaaacacttgagcagattaacaaaacacattataaaatttggattatttgtgaagagttgcaacatttggggaatgtttttattaaatgaatcttttattttactggatgctaatgaaaacaaactcattattttttatttggggtacgagtgttttttggtgacatggatgaattatatagttgtgaattttgagattgtagtggacccgtcacccgagtagtgtacgttgtacctaatatgtaattttctatcccatacccccaccctctttcttctgaatcttcaaagtccattatatcacactgtctgcctctcaagctcatattattgaagacttttccctataattttatattatttttatgccataatctgatgcttaatttctattttatttattaagtatgtttattttagggttaacattcataatgatcataaaaatcaggtaagctacagtagatgtagaaatttaacgtgtgtacacaacagaatatttcatgaaatttgtgtttaaaaacttgatttacatgattaaatcatttatgtagttttgaaatcagtgttatattctcctcaaaataaattgcatggaagttttaataggaatctcccacatacagtataattatttatctaaaacataatagtaaatatgtttataaattttactcaagtttaaatataaatagcgtttaccgcattaaaatatgaatttatcttattttattacatcaaattgtttgtcagggtcatattttatttagcgttccactaatgactacttgaaataaatcagagaaggtaagtcccataacagcttatgatctaggtcagtctcttcagatgaagataatgaagtgatttgaaaaactgactctattactgaatagtggtatgcttacttgagatagattatttatagcccctgcaaacaagagcagagttattttatattactgagacattttgaacaagaatgttagacagagtgaattgaataacttttcttaggatttagctcattttctatcatttcacatgtgttgacttttaaaaatctatttttaattatttcaactggcaatttaataaatacatttgcataatgtcctgaaagttcagggtagatttgtatgtgtaacgttctcaaaatagaggggagaattgttgggaaagctttgcatgttttatcttaagcaatactttttccttaaaaccaaagacattgaaaattacagccacaggtggatgtttgttttgagctaaaatagttaacagtctcatttatgagtccttgctctttccatttagccccatcaaaagggatgagtttatttacacagtgaccgtcttttttttttttttttttttttttttttttgagatggagtcttgctctgtctccaggctggagtgcagtggcacagtctcggctcactgcaacctctgcctcccgggttcaagcgatttccctgcctcagcctctcgagtagctgggatcacaggcgcgcgccaccatgccatctaattttttgtattttcgtagagatggggtttcaccatgttggccaggatggtctccatcaacagaccttgtgatccacccacctcggcctcccaaagtgctgggattacaggtgtgagccaccgtgcctggccgatccttctttatttttaataaaatctttaatcagagaaacctggaaaatagcatgaaggcgtgtccatttggtggcttccagataggaacttgatttacctgcaggaagtgacagcttagtaaatgatccttttgaaaatattgctgttattactctttaaatccggatttgtattaagccatccttgctatgtccttgatccttctttgaatccattgcagactgaaatatctcaatccgccagatgttctggtactgaacaatagctgtacaataataatgatacaatctcaaacacatcacagatgcactgttagtatccattactgtagaagaaaaaactttgttagcacacgctaattacttctgtgatggggaggaaaacaaaaatccatattaatttatatctttatggtctgcattatatttcttcatgaataatctatcttaaccatttattaaactatgaatacatttttataaatctggttgacatttaggtattttattaaacacaataaatgccagaggaaattgaattaagaaagcttgtaatacgctttactactagttaaaaaaaatttgtagctgtaaatggttctgctctatatcaagaataaatctgttcccagaccacagaattcttgttctttttcataccagaggccctgatcttttttgttgatagctggtttttaacagcttcaccatatgttttattccttttgatttgtaagaaatttgattatcagccttgaacagaaatcataatcacagcaaaaggaggcaagtaacttggggaataatacagagtcatttgaacagcagtgtgaagtctgagtttaactgactcagatgcccactctagtagagcactcatcagacttcagaccgaatccacttcggacagagaagtctccataaggtattcagactggcttcccctgtctttaaaacaaataaataaactctacttaatataataataactgaatttaagtatttccacagattagcaatttacgtgagagaaatcagcaataacatcaagcatatagcctgaaagtctgaaattgatgagagggatacaattggagccactagttattaatcatacgtgtgtatgtgcatgtgcacgtgtgtgtgtgtttgtgtacaattctgtctaaattggaactgatcttaaacccatttatatttttttgtggcagaaattttatgaggtaggcagggtgaaggaaggcactattaactttgactttataaaacttagaattgggctgggcacagtggctcatgcctgtaatcccagcactaagggaggctgaggcgggtggttcatgaggtcaggaatttgagaccagcctggccaacatggggaaaccatgtctccactaaaaatacaaaacttagccggcatggtggtgcacacctgtaatctcagctactgaggaggctgaggcaggagaatcacttgaacccaggaggtggagtttacagtgagctgagatcgtgccactgcactccagcctgggtgacagagcgagactccatctcaaaaaacaaacaaacagacatcttagaattgtttggctctacgttggttatgtaatttgaaacaaatatatgttgtgggataatcttaacgtgagctaactggtatatattaactaaagtcgttgaaatatttaattttgaaatgcaataatattttctcaaattaatgctcccgcctgaaaatctgtgagccagatagtaataattaacttctacctctacctaggattcctccacctccaactattttatcattggaaatgcatgaaggacaaacaactcaccatttctgcccactttagatgctaaggtgatattgatcactttgtcccatgtggaagaacatctaatgatatgttgggatgtctcatccataagtttattagtcaatcttatgttttatttgtacctagcaatgccaagcacactgtatgtgcttcattaatacttgtgaataaatatgtgaatgaaatttcaaaaaccatgaggtgcccttttgtggattcaatatgttttgtataatggtggagccaccctggaagaagctgctttgtttacccataacagcttatatttattgtgtgagacattgtccttcacagtttacatatataatgatgatatagtcttcaagagtatgaagtatagatactgttaacatctgttttcagataaggtgctggcacttagaaaagttaggtaacttttcaatcattccagatttcctaagacatagagccatggcgtaaatctgtgcacttgttttaaaataatacagctttattgagatgaaatttatataccatatagtttacttttttaaagtgtacaatttagtatattcagagtgaataataattataatactaattcatcattacaatcaattttagaatgtttttatcacccctgccccccaaaattgcttccactcgtttcccctattcactccccaacccagctctggacaaccactaatccactttctgtcccgacatttcattaaatggaagcaggcgatatgtggttctttatgactgacttatttcacttagtctattggtttttaaggttcaccaggttatagcatgtatcaatttctttttattgcagaaaaatattacattgtatggatataccacattttatttatttattcattagatgatggatattaatcaatgctcatttgaccacagctgtctgttatctgtctttctcatgactttggattaaattactactatagcaggtctctcataccttgcaatttcagcagctccgttgttcagcgctgctagttctctttcagcactaccgcagaggacagctccaagtttatggtttctgagtcccacaggcgcctctgattctgcctagctgagatcctcagagaggtataataaagcaagcaaatctgggtaggagcacagcgactttccctctgtctgcaggtatttagagctgattgtatcctcagaatactgtgtaaacggtatattttgtgtcacaatagattatcacctttggatttttcattttcaataggaattagattatggcatctttggttgagtgttatttagatttcctgtaaatctaggttacatataagtaggtaagatgcacagtgaaattcagtccatctatcttttgatgggttattcgaagtagtagtattaaggatcatttggtgaaattacttgttcattacattgtaatgggaagttagaagccaatatgtaagtagataatttcttttacaatatattttcttttcaagtttagatttatatgcttattaactttatccttcatatcaaattaaatttgttattgaatgccttatgtaataatcatgtagcttagttacaatgctcaatcttctgtcataaggtatatttgtatacttaagaatgaaattaattacacgttataaacatcacagtggaaaatattagttggattattaatctacaccatttacattctatgaaacatatttagggccagattctattagtacttttaaaaattttacatgatccttgacattgattatgattaaagacagaccaaagggaggaaaggggtgttatatcacttatgaggaagacacttaacatcttttcgcttgagttcacaacataatttagatgaaacactgttggccttggtaattaggaaaataataaaggcgaggagttggctttatcacattgtgtgaactgacccaacaataatgtgtcagaaatacagcatattcccagtttgtttgctcaacagaagcagataaacagaaggagctttctctaagccacatacattacaatggagacataaattacaatggagctttttccattgtaatttatgtctccattgtaatgtatgtggcttgggaccattgtctttgtaataatctggtaagattgtatcttttgaaaacatcaaatgtgttattttttcaaagtgatttggccaacggggaaattatgcagttatttatttatttattcataagccactaataagggcaaaactgagattctaaaatgattagaataataataagggtgttaaaaagtgatttttcacttcctatggcaagcagaattcacttataggtccatttccctggtgctgctatgacctttatattcattttatgctcagagctatcaattgttttcaaatgttgacacttgaaaaatcgctgtatgaatgatcatgtagttcccacagttattggtgctagaaatttctgattctactctggcctgggcagctgtcagcctagcatggcagtaagtagctttcttacctattagagaatgccctcagttcaaagaaaggagacatatgtgacaactgagagggttaattgttcctataaatgaattcattgaaaagtatttcacagcacacttgtttcaggcaagtctctgagaattattttatttattgtttttttggttgatcatgaccttttattgtgtttatttgcttaatattctgaatcaacctattgctgaatttctaagtaatgtactttattagttgctaaatttaacttatcctttcttatataccaatgatatagtttccaaatcttagattcttcttgaatagtactttctctttatgttgaccaattcatatactatactttgatgaaattatttttgtgaatcttctttttttctaaatgagatattcatgtatgataaacataacctttttaaagtacgcaagtcagtggtttgtagtatattctcagattgtgcagccattatcattattaaattccataatattttcaaaaccaaaggaaacccaggacccattagcagccactccatatttacctgtccatcaactcctaacaaccaccaatgtacaatctgcctgtatagatttgcctgttcaagaagtgtaacacaaatagagtaacattatatgtagagttttgtgtctgacttctttcagttagcatgacgttttaaaattaatccatgttatagcatgtatcagtacttcacttatttttatggctgagttatatttgattctatggatatacaacattttgtttattcattcatcatttgatggactttggggttgtttttattttttgtaattataaataatgttgctttgaatattgtgtacaaggttttgtgtggaatatgcttttattttgcttagatgtcctaggagtggaattgctgggtcatatggtaaagctatgatgaactttttgaagagtgataaatgaaactgtttaccaaagtgtttgcatcattttacattctcagcaacaatgcatgagggtttttatttcttcccattcttgtcagctctatatgttgctagatttgtggttgcttgttttttaactatagtcatctaagtgaatggaaagtgtttctcattgtggatttgatttgcatgtctctaattgctaatgatttgagcatctttcatgtacttgttggacagttgtgtatcatctttggataaatgtctgttcaaatttttgtctattttttaactgggtcttttttcaatatttaattataagagttcttgatatattctggatatattttggctatgtagtctaagtcgtcagacattgttttttttcaggatgtttcagttacttggagcgtcttgaatttccatatgaatataaggaccatctttataatttctgcaatacaacaaccttaaacttttacaaggattacatagaatctgtaaatcaatttggaggtattgcaatcttaacactagtaaatattccattccatgaacacgggatgtcttcccatttatttaggtctttttaaaatttctttcaatgatgttgtctagttttcagtgtacacatctttaatatactgattttattaaatttgttcctaagtattttattatttttgatattttaaatgaaatttttttatttcatgtttgaattgctcattgctagtgtatagaaataaaacttatatttatatattgaacttgtatcctagaattttgcttgaacttgtttattaaatctaaaattttctgtggattccataggattttctatgtagaagaaattgagatagttttgttcattccttccaatctaggcacattttattttattttatttttcctaattgtcctagttaggacctccactacaattgaattgaaatagcaaggccgggcgcagtggctcacgcctgtaatcccagcactttgggaggctgaggcgggcagaccacaaggtcaggagatgaagaccatcctggctaacacggtgaaaccccgtctctactaaaaatacaaaaatgtagccgggcgtggtggcgggcgcctgtagtcccagctactggggaggctggggcaggagaatggcgtgaacccgggaggcggagcttgcagtgggccgagattgtgccactgcactctagcctgggcgacagagcaagactccatctcaaaaaaaaaaaaaaaaatagcaagacaaccattcttgtcttctttttgatctcacgggaaaagctttcatcttttactgataagtatgatgttagctgtgagatgcccatttctgcaggtgcccttttttaggtttaggatcttccttccaaggattttcctttctagttccttgagtgtttttttatcatggaagagtgttgcattttttaaatactttttatgcatgtatcaaatgatcatgtggcttttgttctttattgtattaatatggtgtgctacattgattgatttttatatgttgaattaatcttgctttacttgaataatctggtctatatcattgctttacttgaataatctgttgtggtcataattctttttatctgttgctagatttggtttcttgaaaatttttgtgtctatcttcataaggagtattaatttgtagctttcttatgatgttcttgtctggtttgggtatcatggtaataatgggcttatgtaatgagcctggaagtgtttctttgtcttctagtttttgaagaatttcaataaacattttgtggaatgtaccggtgaagccttctgctcatggacttttttatgagaagtttcttgattactaatttatttactttccttgacacagggttattcagattttctgtttcttcttgaataaatttcagtagtttttgtctttctaggaatttttctatttttgtctaaattatctaatttgttgataacgtagtggtttatagtaattgccttataatcctttttattaaaatatctgtaaattctgttgttatccccccttttattctcaattttaggattttgaattttctcaattgttttgtcagtctagctaaagttgtgtcaattttatttacattttctaagacccaatttttgttccattgatttttttctgttgttttttgtttgcaattccctttatattttactccagtctttattattttctcccttctgttgctcttcttttccagggtttcaaggtggaaagttaagttattgattttaaatttttattctttttaaatatacgcattcaaagctttacattttctttgaagcacagctttagcttcatcttttaagttttggcatattctgttatcattttcatgcatctcaaagtctgaaagtaatttcccttttgatttttttcttgaccccttggttatttatggataagttatttattttccacatatttacaaatttcccaaatttgcttttagttttgattgctaatttaattttattgtggtcagagaacgttttatgattttattccttttaaactcattgaagtttgttgtatcattttttatattatttataaaaccgttaatatttcaatatctctaaaatgtaggaaaaatgtatataaaatatagtctgtagatcttttacagtctaagttgaaaaatgttttcaatgcacttaagaagaatgtgtattctactgtttggagtggagtgttctatacctgtttgctggtctagtttgtttatggtgttaaatcttctggatcctttttgatcttctgtctgattttctttccactatttaaagaaggattttgaagcttttcaactattattgttgaattttctatttcttctttcatttctatcagtttcccttcctctattttgagtctttgttttttaggtgcgtgtaagtttataggtattattttttactggcagattgacccttttctcattataaaatctgttcatctgtactaaaatttttggcttaaagtattgaagtgtgatattagtaatgctgttccagctctttttttggttactgtttgcatatgtccttttctgtcttttaactttcagcctgtttttgtctttgaacctaaaatatttcagttgtagacaatatatagttagatcatgtgttttttaaaagccagtgtataaatatctaccttttaattacagcgcttaatatatttatatttgctataattacaaagtaatattgatgcctgtgtttcctacttgttttttatatgacttatttctttttgtttgcgactcttgtttcttccccatttccatcaacatccctgcagtccaggccttcacatggcagggaaatgacagatgtattataccctgtttaggtaattgttgccatttcagaatggagtcccagtgatgcttggtcttttaatatatgagtggaaatcagaatttttaagtttttggaacacttcaatattttaatgttgacaactaatagagtttttaaaaaatacattagacatagtttgtggaacaagcaagttatgtctaatgagcacatggaatcaaagagaaaccatttgccacctctgttttccacatgtggaaagtctcaggaccagctcaattctggcatgcttgctttcatatatgttgtttactgatacttacataaatatttcctatctgtaaaatagtgggaaatagaaatagtaaaagcttacttgtattaaatactttatggtatgctggtgatgtttatgtccctacctctttttatatcaacttattttagttttcaggtggaatatgttcaaattttatcagactccaatcaaatactgcagtagtttctaagtcttagagctgttggtaccagatggatggatggatgaatttgtgttctcatgattgagacattacgataaggggaaagagtattacagcaacagacaaatgacttggctttagccctcaactaatttattgggtgcttttcaagtttcctactcttataaacttcagttttctcttctataaaatgaaaagattagccttgatcatttttaaagtcccccaggctaacattggctatgactgacactgtggagctatgggatctgcatgagaaatttttctcagtcagtacagcatgcacaagggagaatggctttattttatgtcacaatgcagaatgtctgttgtttgctatccctaaaagtgatgtcctctatgatttacaaagcctatggagacatttgcagcataagggaccgccttcccactttttcacctcagcacatgctacctcatcacactttctccttatttttagttttatgccatcatctgcaggtaatgtttgacctaaaacctacaccattacttgttcccttttaaaaatggcttcacttgtaccccaatggcatatcgagcacctgtgagacttcaggtgttgtttgatagtttaactaaaattaccatgattatctgtgtatatgaaaggcttttaaccctccactacctaaaactcactcgttctgtgctctcacttgttttctattataatacagaaataaaaggattgcatttgaatactgaaaaattgtcttactgccagtgcttgagtgcacaaatccggttaactctcaaatgatagctattcaacctgtctttcaaagcagtagatgtgttttgaaaatttcacatttgatttataaacaaaaagactcccttgactttatcctcctgttttccagacttttttattttttaagaatgaaaaataacagctaaggaatgtggcctggaatgaaaatatccgaatcagaagcaaacagaataaaaacacacctacctttccccctgaaataacattaatgtcttattggatctgacaaaattcaatgaatttctaattaaagactgtttccccactcctgattcaacctgtcctgcctagcagtagtagcaagaatgagtcatagtctcttcagaaagtaaagcattgcagattgagttaatgatgaatttttcccccttgatttgaaatactcttgcctctgtctttccgtcaaccctagaatagtaccttgatttgtaattttatattgattttaatttgcttcattatttttcttgtagccattaaaaatatatcaaacagaatcatacttgacaagaagcataaagaaaccttccactgatactggaactgttgggttttctttctactgaagcttttaatgattctttgccaatctactttttaatcatctgaagtaaaagtagtataaagcgtgttacttgaagcattcttgacagagaatgcagctgtgcacctgtgagaacaaataactgatgttccttttggtcactcagcaggaatagcattttaataggtttcttcactgatccggcatgctaagagtagtttgtagtgtgcatttaatctactgtctgtataggtagctcattatgtcaaggaaaggcttatgcacatttataatactttgtaaactgtatgattagatcattatttagaaaattgcttgtatgggaaatggttgaatagaaacatgttttccaagcaattacgtttccttcttaaaactctttgtccttcatttaaagataaacagaacttcttaggtaacccttagatattttcctgagttatagagttttggaggattcttaaggatgtgtatctgacatattgtaagcacgtaataaatatttattaaatggatgaatgaaactaattaagaaaaaagtgagagtttttttttgatacgataaaacttttttttaagataaaaatggcactttgggaggttaaggcggcaggatcactgagcccaggagttcaagatcagcctgagtaacatagtgggaccttgtctctacaaaaaataaattagccaggtatagtggtgcacacctcgtgaggccaaacatattgctatgaccagtggaataccagtggaaagaacatgaatcacaacaggatggcaggttttaaaaccagttgctaggtctccttttattaatgttgtggagatttcagaaatgtttattaatattaaatagttttcatcctcctgaataattagggcaatcaaacactgccaaccaacatttgacatacagcataaaagtcaagtaaattgcatttatttttgctgttaatattggactatcactaagcaaatcttgctggtgtaaacttcttagtcattggccagtttgttacaaagatctatgaaaaattcttatcccagtgagccaggagaaacttctcccaggagatcctgaaatctaaagtaggaacacatgcctctctatgtgacatccattgtgacacagatggtttggtcctttccaataataaaaaaaatggtgcgttttggaatacttgtgctttttgaaactataaatcacattatgagtataaagaacacagcttttgaaaaaaataaacttttttttccaaatgttggagaaaccagtgtttccagttgattgacctaagatgggtgttttaggcccttttggatttttaaactgtttttacgtgtatgtttctgtgtgtttgtgtggtggcttgtatttatggatgtgtgctgttcgttgctatgataggaaataacattgaaaactggagttatatgttattaagaacataacaaaaataaaaacactgtgtgaaaatctgtgagttaggatcaaaaattttatcttcaggcaaatatatatagccttaaaaaagttatcacatgacatattgtaaataaaatgaagtaatgttcaacttgaaaagttagaaaagacaataaaactattggagtaagtaaaataattaaaagatgattaaataatgatcaagaaatagaaacaaaaaatagaaaacaacagaaaatagattagatagatccaagaactattacttaaaagcaagacgtacataaactgtttaaacgtcttgtacagaaaaacaaaaatatagtcattataagaaggggttatatcaatactgaagggattaaaaatattaaggaaaatggataatatttttatcaatgcaaattatataaattaactcatgtttaaaaacattaataaacaagataacctaggaaaagaaaccctgaaaagttgtcatttttacctccaaaaaaatgcagtgtgctgtcatcttaatggataaaccactttaaattattaacagataagcaattttatggtaaaaaaattgattcagaaatagaggaaaaactgaaaagtgtcctttaccaagcagcataattttaaacacctgaaacagaatctgacgctcagaataaatatcagggccggaggtggggtggtgattctgaaacccctgttagccattagccatgctcatacagtcactcccaactatatgtttgatatactttcttaaccattcctgactgaaaaacactatagagtaacaaaaataattagtagtgtagtaatagattgatactttatatgacgcaaacctaagacaatatagtacttaaggagaaagcatttcaggcatacccaccaaataccccccaaaataaaggatgcttcccttatactttgtttaacttagtgattcttaaagtttttctgtctagtaagagatgaaaaaggaataactgtaaaattggaaaagcatataaagttatttctgcctataagaaatatgattatgcccttatttatacctatgaatctgaaaactttaaactaaaaatacatgttttataacaccttttaaaatgtactgtttttatttaatttcagttttcttgtcaaaaacaaacaagagtgtacaattaaaattgataacaacaaagtataaaattcatatgaattgacttaacaagagatgtccaattcttatgtgacagaagccataataatttgccaaagaacatgaagtttcaataaaatgggaaggttaaatatgatacagaatttagtttcatgcacacacatacatatgtatatatattagaattctaaaattatcctgaagtacaactggaggaataatattcaagggtagccaagggagtttcgaaaataactaaaaaaattttttaatgaaatgtttatataatattagatggattagacaaatgaaaaggtcaagaaactgacctacatacatattagaagtgaatttctgttgaggttggcatttcggtgaagctgtataaatgtggattatatgagcatgatgtgataataggtgaaagggtagggcaaatcattatctccctgtatatcagatgaaactcagatttattaaggaataaatgttaaatatataattacaacagaatccaaacaaacaaggtaactatatgatttggggataaggtgagcctttctttaaaaaaaaggataaaatgagatatctatcgatttaatactgtagtaatttgatacaaatgtaaaagaaatacaattacaattattaacaaaatgagaaaaaatttgcaaatcttaaacggaaaaaaattgcgatatctctaaatctaataagcaaatgacatatcaattaagcagcaaaatatgaacaatcaattttgaagaataagaaatacagagagcttcttaacagcttcagtgttaatcaatgaactgttcatttaagttattatatcatgtttcaggtatcaaattggtaaacaggaaaaagaaaaattaatgcccactgtttcagaggttttcaataaacatgttattttatatttcctaagagtttttaatttaaataataaaatccactgaaatgtacatcaaaaagaaacatgcatacaaaaacaaaaggagctttattggaaatgtataggacagttcacagaattaaaagaattagctatgaacagctatgtagaaggaatttgaaagttagtcaatatcattgagcataaatcagctccattttttttttgcacgctataataagtaacttctcttgaaatgagaatttctagtagagaaagtgaccaattgatttaacttaggtaatttttgccacttgtatgaattaaggtgaaaactttagacgggctgtcttgttgacactcatccaacatgtattcatcagtttcccaaacgagaagtgggatgctgttatctgaagtaaagagaggcacttggtaggcgaaaacagtggatatccagcttggttattaataaggatgttaacagtattattttttttaatggtgggcttacgagatttctatttttctatttatgctttttgcttttttctatttttttcctcagaaataagactgttataatcagaagtaaaaaggttactgaaatatgtaactggagaatatgttgagacaccctgaactggcccatttttagccaattcatttttttaatgtgctagataaatttatgcgtcctagaatcagaaggctttgaatcaatcaagttctggttttaccagtaatgaacattagtaagacatttaactagtgttgagtcttggagctattaactagaaattatgaattatgttactatctatataaaacttttaaaaatttggcttaaaaaattacatccacatgtttaatatatttataaggcagaattccttgaacatatatatgacctttgatgaatgtttgttgaatattttcagagtttcttaatgccaatcccaaatatcacttagtcaaaaacttatttatcttgagacttctaacttctggtattatttggttatattgttaccgtttcttcactgaaaaaaatgtcacctcccaaatgtctcatccttgtgttttatttgattttgaagatgtgggtcatcttttatgatgaacacaggttctatttttatatcataatctcatgatgattatggtgaaatgaacaaattaataaatggaaataacagtagaatatttggtggattgttaatagatattaagtactctagcagatagagtcttttattttatttgatctctatatattaattcatctgtctgacaataaaatgtgtttttaaagacatgctttatcaagatgtatttgaggcatttccccccactgatctattgtacttaaaaatttttgaaagctcaaattacactaaatgactgcagaaaaagtcccaaatagtaagttgccaatttgaaacttttattagtctcaattagttaatttattgaactaatttaaatagatcaataaattaaggtttataaagaatattcgggcagtctttttcttaagagaatcctgcaagactgaggcataagatacagtctgttgatgtttttatccctttcatttatccaaacagtgtaaaacattgcttatcacattggtatgacttacaggattcaacagaacacttagtcttttgtcttcattttccccattgctttgtatttctttagatttaagttataattaacttgaatattaatcttagatggcatgatttgatatgttaaaacgaagagtttaagacgccgagctctgtggttctcgccttagtaatgtacacattacagttgccagttgacaggtttcatttatccatggttttctttaaaatgcctattgatgcaaacctttttaataagtaactcaaaaggaaaaacacacaccaattaagttgacagtgatcccatatatttcttcctctaatttcccttttgtgacttcattttccttcccccatgccttcctttctttctacatacatgcacactatcaccattctagtggcccctgcctttaggcaccatgtttaagctctcagacctctcttaaatacttgtaacactatcaatactacctattttgttagcataattgtatggactacatggcaaatatttctgaagcacactgtaaatgtctgtataaatgcaaggattagcgttgcccgctgaatctagacctgatggattatcataaagaagacaagtttgcatatctgaattcaattaacagtggtacttgtttgtgatggagttggggtttcatttaactcaatctcattaatttatgcaaggaccaaatttgtttagtgtagtttatttgttagaagaagctagcgggcagaggattcatcaaaataataaccaaaacactcagaaaaatcaatagctacttttcaactcctgatctttgtcctcacccagagtgagttctaagcaaaattgtgcaggttatcattcctggatttcgcgctccctctcacacacaaatcctgaagagcattatcatacccattggttcgttgtgcagtggatcaccgaggcatttctttatgtgtactctttggcctaccattccgttctaatggacagtcatagttcatagtgagtttgaagtctttcttctagttaatctgtcaatttttctcacacagtgcagctgctgtgaaagaaattggagctgttacactttgtgctttggtacagtttgtaaaatgctaggtaggagacaggaaaccaaacacagcatgctactaatttctttaaaacgactgatgtgctagaactcagagtctgtgtcccagagagctggcatccctttttttctgagaagactaacgtcgtttgaaagtgttatcttacttttgcatcaacgatatagatgcctttggtatgacttacaggattcaacagaacacttagtcttttgtctgcattttccccattgctttgtatttctttagatttaagttataattaacttgaatattaatcttagatggcatgatttgatatgttaaaacgaagagtttaagacgccgagctctgtggttctcgcctgtagttccagctacttggaaggctgaggcagcaggactgcttgggcccatgatattgaggccacagtgtgtgatgattgcaactgtgaataacttctctagcctgggcagggtaacgagaacttgtccctaaaaaaaaaaaaaaaaagagtatgtgtatattgatatgtaatcatgtgactagacccttcactgtatactatataggaaaagatatataatatgctagaaaaacacactataagaactgttcttaccagaaagtaagcttattccagaagaggttggccctgtctccatcaggaattgtcagaattacagggatatagcaaagtgttctttttgacacatcaggattcctttctcttgaatgaaatgactatattcttcttcattgaagcatttgtataattaatcaagatgtttgtatattactctcctcctaacatgtgagagctgcaggtattttaaatgagaatgcttcaggatgtgtagtactgtctctgtgtgcagatttactttttattttatacgtctggtttttttgtgtgtatgcatgtgtgttgtgttgtgtgttttcagacagggtctcccactgtcacccaggccagagtgcagtggagctcactccaccctccacctcctgggctcaagggatcctcctgcctcctcctcccaagtatctgggactgcatgtgcatgccactatgcctggctattattattattttttaatgtagagataaagtcttgctatgttgccaaggtttgtcttgaatgtctaagctcaagcagtcctccccacttggccgcccaagttggggataaccccacttgggataatccccaaaacgcccaaggttttgggattatagatgtgagtcactgcacctagctgtttattttacggaggggccagttaactaattccctcttctaataaaattgttttgtaaatccaaatttgttcttgcctgttactactatttagaattttgcaattttattatacctagtcaaaagaaggaaggacgattcaaaaggaagaggaaagaaaattaatattaatcaatatatatcaaatgcatactaggcttttagcatcatctcaaatattttatatatattatttaacattcacaagtaccacataagataaatattacagttatgattttacacatctgtaatatccagagatattcaagaatcatagccagtaagttggatgaacattgcctaaaaaacacatttttaaaatctgaaagccagaacacttaacccttgaacaacgttagctgcatgaatccactaatacccacattttttaaaataaaagttacaccaagggtgcctgcctttcctgcctcgccttccatctctttcacctctgtcaccccagagacagcagaactaatccctcctcttcctcatcctcttcagcctactcaacttgaagatgatgagggtgaagacctttgtgatgatccacttccacctaatgaaaagtaaatgtttcctctttcttatgattttcttaataacatttctttagcttactttactgtaagaataatgcatataagatacaaaatatgtgttgactgtttatgttatcggtaagacttttggtgaatagttggctattaaagttttggaacagtcaaaattaaacaccgatttttgacttcatgggggttggtacccctaccctcctcgttgttcaaggggcaactgtatattctttttggtgtatatagagaccctgtaaaagagaattaaactttttcaagtccctcatttgtaatagtaatacatgtatagcctttaacaattttaaagcgtgctcttaaagaacattttctttgcccatcataataaatgcttatattaggcattattacctccgttttacttgttaaaaatcctggacttctacaatctgtcagagttggagaatcaaaggagaaagtgccttagcaaagagaatatagctgaaacaagaatcaatcaggctgttggggatataattctggaatgaaaattagactgaatttgttcttaagcatctttgttgtttgagctctttgttttctcatgtttagaatgagaagtggggggatttaattacgtttagtgacctttcaagctctaaaatgttttgctacttgaaagtgtacttagatgtgttaatgttatatacagaaagaaactgactgaagctacttaataaaaagtaatcaagatgaattataacagaaatagtaatataagataggaaatcctgaactaatattaggttatgtgcctaaatttgtgatttttatttaaacctggccttaatatttggcttcatttacctttcccttttaacctcagcgtcccaccttaacatagaatcaatctatgctatttgctatgtatcccaggtggataactgttcttgtagttgaccttcataatgtaactttattggtatagttaaggttaatggcacattaattttctataagacatcagtcagtatcccattttaatttaccattttcatgatgactgctgttctaagttgtttgtgtcatttttggctgccataaattatcccgaagcaaatatcaatgtgaactcagaaccatgcatgctgatgacttctgaaattattaatgccagtacataggaaaaagaaatacatgagtgcacatttggttgataatttctttatagattaccattaacctctttctttaagggaacagcataagtacatctgtgtttatttgctctaagggaaacaacagttataattaggaataattataacagcagcagtgaaactctaaaaaatatcctggaattactatcattcctaaaatatttttatttcagtggaaacagccaccattaggatctcatgggagagttcaaagagaaatgatagattatttcagatagacccttgttgggtggctgaattctcagagtggaaatagcagataatttgggctctgttcaaagcagtctgaagaagctctgtcctatagctctgaagggacccattttaattcacagagcacattaattgttatcccccttataaacatgtctttgtttgaagcattatctcaattgtgaaatgtggcttagaacaattctagatagtatagtggtaaaaaacttcaactcaggagtcacatagatatgggttcaaatctcatctccaccatttattagccatgtacccccatgaaaattattttaaacttttagtttccttagctttaaatggaaataataaggctgtccccacagaactgtcctgagggttaaagaatctttccagagtgacctgtacttagtaaatagctcccaaaattgtggaattctgtagctgtttaaatgagaagagatttttattaagaggtttccaaatttgtcctctttagcatgccattattgtcactttcaatcacttgggttttcagtactattattttattattttttcttcatatcagctttaaatttattctcttttcatacttagtcttgtcaaagccagattgtctcggaggtcttgatgttagacgacctagtatctcaggtttctctttgtaaaacaattgaattaatacatggatgtggttaggaaagtcatttgtggtcacataaacttcagaatcctttatgtccagttcttctctgtcacttgggtattcctgttataagagagaaaggagtcatatttagtgacatgatttgaccttcatttttacttaacctttggtaagtaacagtgagctgcttcaaaatatagtagtatttgtgtattaaaaacccacattcatgatccttaatataaaccaggcactgtgggaaaccacaaacagaggaaagaacattaccaacacctgtagttatttattttatgtgctttggaaaataagttaaatgccctcaggagcagtgttcatacatgaaaaaattctctacttatgccacaaggtcacataggattgtctgtatgataaagtatacattagattactctatctattttgtaacactttatagctgtaaggttgtatttttaaacgagcaaaaatgaatcaaaatttaatttgaaagcagggactcaaacagatacttctgtatcaatgttcacagcagcattacttaaaatagccaaaaggtagaaacaacccacatgtccatcaatgtgtgaatggataaacaaaacatggtgtaaacataggacggaattttattcagccttaaagaggaatgaaattctgatacttgctacaacatggacgcaccttgaaaacactaactgactgaaataagcaagacacaaaaggatgaataactatatcaaatatcacatgtaaggcacccagagtagttaaattcagcaagacagaaggcataatagtggttagcaggggctggggagttatttttttaatgggtacagattttctattggggatcatgtaaaagtgttggaaatggataatggcaatggtgacacaatcttgtgaatgtacttaatgccactgaattgtacacttaaaagtggctaaaatgcagactttacattatgttagctctccacaataaaatgtatactgaattttaaaaagtgaacagaaacttagaaactaaaatactaagcatctaattatctgaaatatgctgttaagtgtctttttcttttattgagcaactagctgtgtgtatttaatattctaagatctttaaaatagaggaaaagttgctcttttcctatttaacattctaagatctttaaaatagaggaaaagttgctgtctcagattggtggatttcacattgatggaatactggaggattaccgaagttcactttcctgggggctctagttcatgtctgactcctgtcatataggcccaaaattgccatctcagctacacagagcctcagcttgataagcaaaggtatttttcttgcaagagctctcttgcctctggagagactgatctggaatgactgtcaataacaacaaccatatacctgaagaatcggtctcttccattttaatttcatagacatgcaccgctggaactatgattattacaggatgaagtctcctataggaaagccggctgagctaacaaaatcaagccccattagtctgtccctggagcacaaactctaaatggccaggggagggaaagtcacacaggagagggcaagtgattggaaattgtagaaaatgggagaacgttgttgcgtgccatggtctcatggagattcatggaacctggtaaattaaagtgcacatccgtcccttaaattgtcatgctgcttcaagtttacttaacttttgtacagacttttacagacttttagaagtatttgtacagacttttagaagtctctccttcttccattgcttgtagctcttagatttaaatgatcacctgttcttttttgtagtcaagttgggatgtgcccccaaacacgtaacatgttttgaaactaaacaaatatccaccattaaattaagtttctttgatgctttcttttttcctggcagaatttggtcaaagcaactatttcattgcaaccctgacttgaataaacaagtacatgcatgctcatatagctgtgtatactcatgtgggctgctttagtgccttgactcaaatttacattactttcaagtataaacaatacaatactaatacaaacaattttgggagacagtaaagtttagtactgggctctataatatgcttgtgtgtttttggaaatctgtaccgtgcattggcaatccagagagtgctggtggagacaggactaacacaatggttcccaactaaggttattcctagagaagggcttctcaacttcaacactgttcacattttgggctagataaatcttggttatggggagctctcctgttcattataggatatttatcagcactcctggcctctactattagatgccagtaacatctgttctcctctagccatggcaattaaaaatgtctccagatattgtctagtgtcctctggcggggagggggcaagaagagcagtttagagcatggcatgaaatcccaggggcagggtgttgggctaattcaaagaggcttagggttttgaagcagtgagtggtgagaggagaagaatgatagaagaaataactggatgtgtctgcagcattttcttcccatggcattgcttcttgtaagatacacacgcacactcacactcatacttttgttctacataacatatatattgtgtagtatgaagtttatgagttataacactgtcgtcagagttatacctttatcctatatccagaagcataagacggtaacttaaaatctgactgttttatctaaaaatgtgctttcttttgggtattgtcaggactcttggtttcagttttaatttctataaatccagagatttgaacaattcccctgctagcttctgtttctctttgtgtcccagatctgtttccctccatctatagccaggacaggagtaacttgattctgagaaccctgagcctaccccaaaaggtaaaggaatcacctttccctatgtccacagattaaaatgagaaaaacatttttgggtttgcttgagtcttaagtgttcttctgacctaggcacttctccagggggctggacaagcctggctcatctaatttctaccctcccctagcccccaactttccaacctcgcaaacaatcataaggagtgctccccccacctcaaaagcagagatgctttatttagtactctgaagacaaaatgaagctgcaatttctttttgaaaatcttccccccagtttttcattcccttattttcagtgagatattcatcctctactttaaatgtacattctcttatagtagttctcaaagtctggtcgaggaaacctgaaggggtagtgaaaactttcaaatggatgtcagatcaaagctatttttgtaataatactaagaaggtatttgcctttgtcactctcagtctctcacaagcatacagtggagttttccagaggctgcgtgacatttgatgtcacataagagcgaatgcagaagcaaataggaggatccatttgtctatgattaagccagacattaaagagagatttacaaaaatgtagaacatgctatcctcctcattattttttgctttatataatattttcccattgaacatgctatttatgttaatatgtaatagacttactgttattttatgaattgaaaagtattttagaagtttccattttaatttctaatgtagtaaatatcaataaacctaatccattaattaaaactctttagcattctccctaattttaagaacgccttttgtttttatggtcttacttgaatacctgagtcttcatcaagttcttgccacgatggcttttagaactccaacatttccagcccggtgaaagccacagaatcttttcagctcaagccctccagtggatgttcacaattaaaaatttcccattttttcctgtatttagatgtctctttgctgtacaacaaggaacttaccagcggtcactacacatactggattataggcaagatagccatttaagggtagcgaaaaatgtaagaatttttatttatatattttatgtgatttgaaacgattgtgatttatatttcattatgtatataacatcagtaatagagtacatatgtgtactttagaaataaaaatacctaattagaggtgtatgctttattttctaatagaaatatgctatcaacaaaagtgatacttatcctataatatttgagcctgttttggggaaaattataacttgatacagagtgaaaagaataaatatttcttttagaggatgtgatggttaattttatggttcagtttgactgggccacagagtgcccaaatatttgatcacattattagtctgggtatttctgtgaggatgtttctggatgaaattaacatttgaattagtagatggaataaagcaggttgctttcccaaatgtgggtgggccttatgcaatcagctgaaggcctgaatagaacaaaatagtgaccttcccctaggaagagagaatttccctgtccctactacctttgaactgggacattggcttttttcctgcattcagattgaaactgaaacattggctcatcctaggtctcacacctgtcagccttcagactggaaatacagcatctcacgtctactgggcctcaggcctttgaacttggactggaaatagactgtcagctctcctgggcctctaacttgctgactcaccctgcagattttgggacttgtcagcctccttaattgtgtgagccaattccttctaataaatttacacacacacacacacacacacacacacacacacacacacacaatcttactgattctgtttctctggagaactctgctacaggagattacacaaactgtaaaggaaatatactatcgcataaattaagcaatgatctctataacttcttcagtctgagaactcattccttctggtcactggatgccttacaaggacagaatagggaaataggttttacttgaagcaagaataggaatggctgtaactgtttttgaattagtactgtctgtgagcccctgggcaatgaaggtattattgtctccattttacaaacgcagaaatcaaagctaagaaagaatactttgcccagggtcctacagaagtaaataaagtagctagaatttgagccagcctttttctaactccgaggcctatcctcttactagttgactatccataaatcaattttctacctataaagcttccttggacttgagtatccataaaacaacttcccacctacaaagatgtaggtaggaaagataattttcaaagtgttttaaatgtagcattgcctaccctggagttcagttaagccacaactgatctgtggtaatttggggaaatttcatcaagttggtctagaattacagactcctgggaatagatgtgtgtgtgtgtgtgtgtttgtgtgtgtgtgtgtctataaagtgccaagcttattttccaaaaggataaaggtatttcccagtgagtaggaaatgtttgcattcttcatgtatttgtgcatggatttccaaattgatggattttgcttcaaaattagtcaagaaatcaatcctggaagttattgtgtgtgtagctcaattcagtaaagtggcaaaatattatttatttcatcctccttatgctatttagtttccatctcattcctcatggtaatggagaaatagtctatgatattgtaaacacatatggatctttaagatttattttatatttgttttagcgttcaggaggcacttggcttttgcatctctccctctttaggaaagaaaaccaggtcatgccttatattttatatatgttttacatgtatttcctttcaaaaatgtgtcatggtatacttagtccttccctttaaagaaaaccataatgcagatctcattaaggaacataaatagtgatacatatatatggaaaaggacacacattctttagtgcagtggtgggaactagtgatcttcctccaaatgccagaataaatagatgttcctagcaaaaagcagggactatatttggaacctcccctattctggagttccagatctgattactcatgtagaatctcctgtttcatatataggtgacagtgttcaggactcattaccccaaaacatggcatcttagcatttgaggaaacagccaaagcagaccatacaaactagaaagaattcccctcaccccttccccactgaagtaggtcataagaccctcatctggaggagtcctgacttatacccagaggaaagcaatatcacacatggttgccaagaagaatttgaacaaacagaatttgctaagttcttcctggtttattactgttatattatacccttttgtcttccaatcatacttctgcacggctgtccattaaaaatacacagttttggccgggcgtggtaatcccagcactttgggaggccgaggcgggcggatcacggggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgggaacccgggaggcggagcttgcggtgagccaagatggcgccaccgccctccagcctgggcgacagagcgagactccgtctcaaaaaataaaaaaataaaaaacacagttttccccaggtctttaattatgcatttctgaataatctcgcatcatgtaaaacttacgttaaattaattgtatgcatttctcttattaatctatcttttgttgtaggggctttagccatgaacattgataggagttagaaatattttcttccttacacgtatacagttggccctccatatccttgggttccacatctgcggattcaaccaactgcggatcaataatgtttggaaaaaaaaaacaataaaaaataacaaaaatgttaaaatacagtataaaatctatttacatagcattttcattgtattaggtgttataagtaatctagagatgatttaaaatatactggagggtgtgcaggagtcacatgtaaatacgacatcactttatataagggaccccagcatctgcagggggttctggaaccaatcccatgtggataccaagggacgactgcattctccaaatcctgggcatgggcataccatatttcttaacatagctgcttaccatctctaatgttgtctatttaccattttctataaatctactgggttttaaactaatttttgatatgaagaaagtttatatcaatataaatagaagtaaaatttttcacaaatggaaaataataaaataaaaattttcacaaatggaaaattaacataaaaataaatttgcaaatatttacaagcgtaacataaatacacatcaacttaaactcaaatgtttacaaaataaaaataatactgtctaccagcagaagtgcaatgaccatattttttaaactatgatttctcctatatgtctatatttcatggctgaaattgtagttcagagctctcaccatcgtttctactacatacaaatcacttatgtcagtggaaatgttttctgccaagaagtgccaaattgtgagcctctcaggcctccagaccatgtttccttcacttctaaacgccattatgtcacccactgcatagttatctagtgcatataggataaacgctcaacgaagaaagccaggtcatgctttacaccttacattttgttttagacatattccttttcaaaaatatatccctgtgtaattaacccttctgtctttaaagcaaaggagttaagcactcaaatggcaatcaccaggaatgaggcccactacagtctaggagcaccagggcagtgcagtacaaaaaactcaagtagagaaaccagtgataactggggaaagttactttgactcacagaactttagttatcacatctataaaatgagataatacactctgccttattgaggcatttttttttattaaaaacagcctttgctttgtaccaggaaaaattaaaagcacttaataagcattaatttatgtagtcctcctaacagcccttatgaggctgtaaaggaacaaacaaacgtttctctctacttacactaaacatgccacactttttgaccagatgtgtgggttttgatttctgacacatccattttcaggtacatagttatgattccatttaattccgatgctgtctacctggagttacagtcagaacccacatgttaagagctcggtcccacgtgaatgccccctacttcagatgccagtcctaaatcgggctccccagaacttctggccaattgatataaattagagattcccatgaccgcctccttgggttcagccatttgctagagtggctcacagaacccaggaaagtgctttacttatatttactggtttataataaaggatattataaagaatacagatgaacagccagatggaagaaatgcataggaaaaggtatgtgcgaaggagcacagatcttccatccccaagcacctccacatgttgggcaacatggaagctctccagttgcagtcctttttggtttttatggcgacttcactatagaggcatgattgattaaaccattggccagtggtggttgagtcaaccttcagcccctcttccctcctgaggctatttaggagtcttgggccaccagtcattacccttctaaaagacttatcactttggagattccagggattttaggagttctgtgtcaagaaatgaagaagaaagaaatgaagaccaaatatatatttcttattctaaagcacaatatcacagaggaaaagagggtcagtatcttaattttataagggaggcatttataagacacagagaatctaagtaatttgtggaaggtcactcagctagaaagtgaagagctgggttttgaaaacccagattctggactcaatcattactctatgctgtatttcttcttagagtatatgaaattatccctgtgaaaatagttagactctggcattctatagctgttttctgtgacctgtgctctatattgtttttctttgcttcacagaaacgtaggtactgttttcccctaagttgttaattaatactcagataaggggcaagcacctctaggaaaaatcaaattataaatgtccagtacacttttatatcacatcacataatgtgacacattaaacagttgtggaatgtcaaaaattggcataatagatgacttgggaatgtagagtgacaagttttcatacaattgtgcctttttttgtgataatggtaaactctggaaaatttcattttctggttctgcagattgccagcacattgacatttcctgtatggtttcccaatgggaaggacagaattgtatttagccaaatctgataattttccttagttgaaattgaaggggctaaaatgcctacctacacttggatatgggcttcaattttttttgaagatacttattttccttctttgtttctaggatatagaggcagttcaggtagtttttcaggatactgcattgtagaagtaggcccttagtgaatcaagccattcatatacaagttgagtaagtgctcagagtaggtgtctatattaaggacagggtcctgtacattgtggggtgcttagcagttttgccatcatctgcccatgagatgacagtaacaaaccccatcttccctatgattatgacaaccaaaaatgtcttcagactttgccaacaaattacctttagatgtaatcactgatttagagcaatagaatttttggctctgtagggtaaatgaagtgcacctgatagcaataaatgacgcataccctgagaatgaccctgtatggcagatgcacctgaatgtgtgttccaagctaaggaactcgggaatggccaacagggagattcattccttgtctatgaggaacatctgaacctccagcctgtctattggaactcaggccacacaggggctcaagaccccgagttttgggttgaatgaaggttgccaggtggagactgtttgggaaagggtgctgagtgaaaatgctatataaactgcatgccctttgcaaatgattgtagttttcctgcccagtcccctgccgctgggctgcggagttatcttgtctagcccactgctactgggctgtttgtaaggcgattctcctgtccagcccaacaccactggcctttctccgtggtaagtaaagctccagtaaaatcccatgtcttgtttgctggccctgggtctctttttcagtctcttgaacctggtgccatcccctttagagtcgataggggttcagcgtgacaggctctttgttgtaaatatttgagattgatgatatctttgcacatattggaaaactttagatttcaggatagtaacttatgggccacaatgccaactacagctccggtaatgttacagtatgatggtttttaatgtgttccctggactagcattatcttttacaaataaaatcaaatcacatcactggctgaatgtttgagatgtattctcttctcattttaaggtttacgtaagtaatctctccaaataagtataatattaatagctgacagataaagagtcttttatatttacaggatgctttcaacttagtcttttctttaatttccccagtaactctgagaagagtttttattcacccatttgattagaaacagagacttaagaagagtaacttctgtctattctgagttagggagatcagaaaataccactgttctgagtagtattaggtgagaagagttttcttgctgattaaaatcctcaagtaaagctcttacatataagacttttatatataagaacaaaaaaccaaacaccgcatattgtcactcataggtgggaattgaacaatgagaacacatggacacaggaagggtaacatcacactctggggactgttgtggggtggggggagtggggaggggggagggatagctttaggagatatacctaatgctaaatgaggacttgatgggtgcagcacaccagcatggcacatgtatacatatgtaactaacctgcacattgtgcacatgtaccctaaaacttaaagtataataataaaataaaattaaaaaaaaataagactttttcctatcctcgagagcagtgtcaaaggctcatgactgtttttctcctgatctccaaattctaaaccatgtgctgcagtttcctatgttgatgtcactggttgttcaccctgggatgtcctatagactggagcatctgtctctatcctctccaatgagctgtcctaattatgttacatcaagacaacttgtgaagctcagaatctcaagtttctggccttacaactgatgagcagcataagccattcccactgctgttctcaatcccctccctgtcttagattcatagatccctaggctcttaagtgtcttccagaactgtttatcttgtagtcaagacccagaaattagacttccagaaacatagctcttcaaggcaggttcttcaaggtgatgatgcctgtgtcaccttgataggaaacctcctacactgtgtaatactgtcatctcagggagagccactgttcattagcttaaattgtcagctttatggttcagtgaaataaatacacattttccctaaggtaatgacttttttctcacttcgtgagagctgtagggacccttgttatcaagagataatcatattctagtggtgctacttattgtacccaatgaaagtcccaaggatgtgattatctcttaataactctaaagcctgttatgtatcatcttgtattttgtttactttgagtgtgtggtggggaacccattagtgatctctgtggttgatagtattcgttgtgaaatgataaaagaatcaaatgaccatttgtttgcttggagctagacagcacgattagaaatgcatcccaattctgactgaaaaatgcatttaaatgtaatctgttgcttagtattagtttaataaccctgatgttaatactaaattatatcaagcaaagctaatggaaattctgaaaataaacatggataatttagtatctacatgacctttacctcccacagaaaattcaggttgggttttaactacctgtgaaggaagtagatacccatgagaaataacctgctgattctgtgatggaaaatgccatcaataagttaagcaaaacaggagaaatataaggaaaagcctgttaaatacaatggcctttaagaatacggacagttgttaaatggtaactcttacctctcactttaggctatcctttgatattcaaataatgttaataataacaagtatcattaattgaatacctgctatagactggtttggcttgtctcattttatctattattgttattgagatggagtctcgctctgtcacccagggtggagtacagtggcaggatcttggctcattgcaacctctgcctcccaggttcaagcgattctcctgcctcagcctcccaagtagctgggattgcaggtgtgcgctaccacatctagctaattttttgtatttttagtagagatggggtttcatcatgttggccaggctggtcttgaacttcttacctcaagtgatctgcccccttcggccttccaaattgctgggattacagataggagccacggcacctggcccattttatcttttgaagaacctttcaaggtagataattttggccctgtcttacagatgataacaacaaactacaagaggttatataacttggttgagttcatgcagcaaataacgtggtaaagcttagactcaaatatgactttagaacctatattttgtccactgattatttaaaggcataatgtacagagtgactaagcgcaattataggagacttgtaatcaatggtgatcacatacacatttgttgttagacaaatccaggtctgactctaacaggcaaagtaaagagaccactctttggtccctcctaatgttatatgctatgtctgtgagaattgaaagctttagagatgccgcatctgggtttttgaacatgttcgttagaattattttcatgctcttacctgtcacttgggaagggttgtttttgttcttaataaataaccgacacaccttttggttttgaggtatttggaaagggtctagatcaggactgtttgttccctagggtaaaatcatcctttttgacctagaccttgccagctgctgcatctaactatttgctattagctgagaagctctgcagtcattcatggatttctggttcctttgttgtaaaattgcgagtacatttatgttgacagcagctgatttgttcaaagattggacccaatctttctgggcagagggagagtcgtctatttattcacctggttgtgtattaatttcctgcctattttcacatgtgattttatttagtttataataaaaactttaacttaggatagcgggtacaagttatggattgaacatggaaagtttagtgaatttttcatgattaaaaaaatgattataatgatagcatttattttctgcatagtatgaactgggcagtgttctcatggattacctcagtctagcctcaaaacaacagctaaaggtaggagtacattaggctcattttattcgaaaggaagctgagcttaaagaaggtgggtaaaatgaaaggtcttgccttgtgttcgcctctagggagagactattagccaatcaagtgcaatagattcagtttctttccccctgtaaagcagcacaaaagcggcccagaaaaaaattctgtgggttttttttttttttttttaaccttctttcaaggtatgaaattgggtatctacctacttgaatcatctctgttcatgctggctaacctaagatgggaagttttaactatgtctactttttcccctaacaagaatacagcaactgaacattttcccagtgaggtgtgaataaataattcctgcttatataatcagcaacttctcaacatcaactgaggtatcattagatattttcttttaagatcagttatgaaaatccactgtggaagtggaacttattttggcgtaacccttagtttataataactaagactatacgttggatccattcaatcattgagcatacatttaaggagcacctgttttagaccaggttgtactagactgtacaccttcagactgaagaataagacaacacaggtacatactttcccacagtaaaaggtatgtgtgttttggggtaagccgaacagtgataaatattttgtgatgagtggtatgctaaagacatgtgctgagtgtaactggagcacaagatccattacggtcctgagaggttatggttttgttaaaaggattatttcaaaagtaatattctcttactgttttagatacattttgatgatgtttgttgtttatttgggggggggaggtggcagagtagagtagtaattttattttgacagcaaatcccaggaggtcaggaatcttggtctgtttcttttctcctagtaaatactttttgaataaaaaaaattaatgtcaatgtaaaagctattggtctatgatagtaaaggaacagttgattatgattcatattcatgagccaggaatttttatatatggaatttccttacaaatttgtaggttgttagcattgtgacttatttgtattcattgctcacttatttgtctgcctcatttctacaggcacaaagccaggactttgtattactcacagaaaacttagcttcagtgggcttatgatttcttaactagtaaccatttagttgtaatatacagaaacttaaactagctcacataataagggttgttgaaaccatatgccaggcaaaatgatagtcttctaagcataaaaaaattatagctaaaacctaacctcatggggacttgacttaggaagtcaggaaatgtggctgcccctcaccttttaccctattttcagttcttcatttctcatgtggatcaggagtaaggatgtatgtaatcctaactctggttttctctaaagtcttatttttctggttctctcaagactggcttctttaacaataattccaactttacatgcctcaaactctcaagtgttgcaattcaaaatctctgagagagaatcttgttgacttaatgtgggtcaagtattaattgatggttcaatagctgtagcctattaggttgaatcacgtagaacatagggctggtcttttcaggagcaacaggtgggatgcattctttacaaaggagatattgtttcagaggccttcttggggtcagtcccatatattccccctcactcttcttacctttccatcctgctttctattctctttggcattgctctttgctccgtggtagctaactgacctgataaatgcattcatgatatgttagttcacccaacagataagttcttttggccaggattccctctggatgcaattacaaaaatcaaaggagtgaatttaataatgttttctataatgggcaagtatttgggaacatatgttttcttgtggtgctgatactgctttttgtgtgtacagtcaccatgcatgaaactatccataatgtatgagaatctcttgccaatgttactgctactagtggatactataactagtggctaaactgaatagctagtctgcattatgtaatttaattattaatttgaggattgaaataatcctttgaggatgaatactgttattgtccccactttaaaaatagaattgaggattatatcaattaaagaattgttcaagatcacatgattagtaataaattgaaccaatatcccatcccaagaaatttatcccggagcttatgttctcaaacaagaacaacataattattttaatgaataaaattaagttttcatttcaagtattattccactggatagggtaaatgtaatctctaccttctttctgtgaagaagaaaaaatatatatgacaaatttttagtaatatttgaaaaaacaaaaaactttgaccgatgtctgtaggattattataattttaattgttattgataggtaggctggagttgcaaatggtgccaatagctgtaaatagagctttagttttacatcagttgctgtccttaatgtaagaaagataggtgtttagatacatactaaacttttgtagctgactaatgtatatacagctggtaactgaccatattaaaaccaaacagatggtgatgtatttgtgattcagaattaatgtgaatatataatttttcataatccataggaaacattttcttacacatgtcatcatttatgaaattgtatttgttttaggggtatatgagaaaggtcagggattattttacatttctgaatatattagcaatatgaagaatacctgtttagtctctaccttctggttgttatcgatattatcctgagagtaaaggtagttaggtatttaatatagagatgaattattttgcaattcagccagagaaggcatacacttaagaaaagatcatgtttttatggctaatcaagaaactataacatttttatccaatcaattatgttatatttaagaataagccagagtagaatagtatgattaaagatatttctgattagctaatctatattatatatatctacataaaattttattttcagttattaaaactataagacagttattttacaaagaagtgatctatagcagaaacttggttagaggatacacatatgaataaacatgaaaacataaatatatacctttattctacgtaaaattaagtgtgtgtgtatttatatatatatttatagggaaaataaatttagttcttcagggaaaaatattgtgaggcaaaaattatttcacaattaaagtttaagtcggtagctttaagagaatgtacaatttatgtgaagagtgtttgtttttgttaggtaccctcattttatgtattcatatacctaacaaaaacgatgacgtctccatttattgctcaatttttattattttaaaatccttttaatgtaccctcttaagaaattgtctcttttattgaatctgaatgccataaaatattgcaggctcctagagccatcatactaacaagggaaagatagagtggtgatgaccttctcaaaagtcactcagctcatgggaggcaaggcggagaatggatcctggatcctaatctacacaattctattaagctggaaatctataccaaatgtatttaatttttactttgtcctaatccaatctgatttaattttagaccgggaagattacaggtaagcatcacctacccataagcctatctatgcttgaaaaaatgtatttatttgtgtattttttctttttattctaggaatcattgacatagagtaactccacagcatgtgtcttcaagagcttccctaaaaggtaagcttcccacaagggaagattttccttatgtgtagttcaccttgattagcatccttagtttctatggaaacattgaaaaccttcccttacagagtgatagcatgagattgtttttgatgtttttatgaatgttgaaattaatgaaagtagtgaagttacataaattaaagcctgaaactaagaaatagggactatttacatttctctctggagaagatacttaaggtaggttttctgtagtttagattaatttgataatccaaaaattttagaatttgtaatcatagaaagtgtatattgggaataaagttgttgtacttttgccaaatggtttcataggagaggatgttttagcagtcaaaccaacacaaatattaagttaacgcagtcctataaatactcagatcttaaaagttgaagcttttgaagggataaaacatgagaaatgtaactcactgtctacaatgtatgcaaattttttccttaataaaatatatagatgtaaaacagtaaaatggttatgttttactttcctgatgctgatccaataaagtaactggtggcttaaaacaatggaaacttattctctcacatttgtggaatctacaagtttgaaatgaaactctcagcaggaacatgctctctctttgaaggctcttaaggaggaatctctttgcttcctctagcttctggtggttgctggcaatgtttggtgttccttggcttcagatgcatcagtcaaatctctgcctctatcttcagttcacgtggctgtctcccctatgtgtgtccaaatattcttcttcttaggaagatagcagtcattgaattagggcccatgctaatctaatatgatcacatcttaacttgatttttatctgtaaagatcctttttaaaaagtcacattcacagattttggagattaggatttcaacagatcttttagggacatctaattcactcataacagtatgcctaaaaagagagtctagtgaaattaaagttaattattgttaacaatgtatttatgggaaaataatcataacatggagtggaggaaggtctcattccattggtatacataaaatgctgtttattttaatgatataataattatctcttgatggccagcttttctcccaagcaagataaaaattattcggtacagggtttgataacattgggtaaaatattagtatataattctgattctcagatttttaacaccctcagttaaaaaaaataataatcctggacatcagtgagaccctgtctctatgaaaaacaggaaaatttagccggatatggtggtgcatgcctgtagtcccactactgggaaagctgaagcgaaaggatcacttgggcctgggaggtcaaggctgcaacgagttgttattgcaccactgcactgtagcctgggtgacagagcaagaccttgtcataaattttatatatatatatatatatatatatagagagagagagagagagagagagagagagtcagaaatttatttcacttgattcttcaggtatttttcatgagctaaggttgagtaaggtgttttttaaccaactggctattgttctgtaacaaaccaccccaaaactcagtggctaaaaacagtaactttattatttcctatgagtctttgggatcagctgcttgggtcttctgatctggaacagactctgcagtattgactgggtatgctccttggtctgagcgcagctcacaggtcagtgcaagctgctccacaaggtccctctcctccagcaggaaccatctttcttaaggcagcaacattattccaagatactctgagtgtcctcaagcttgtttagatgtgctgtgttttcccttgcttttacttactctgttccttctccttggaatattctttctttccatctttttattccacttgaaaatgtatttcctttatgaatactgctctggtttctttgatcctattcattcatatatctttgtgtagctgaagatactgaactcatatccctgttagggtgaggcttccctcttgtgccaacatcagtgtaaacaatatgatattcacattgtcttgtaattgctagcttaattatcttaccctcccactgtgaacttctgaagccagtgattgcatcttcttgttcttcatggtattccaagaacctagcagtgcatgcacagatgatgtcttccataactatccatggacagaatgaaagatttaatgacatcttccctattctaattcctctcttaaaatttaagttgttgaaactttccagaatttggactgaaaggcaggaggtaggtttcctctcattttgatgatgccccttggactctactcaaagagggcccaggcaccctgtggtgccaccctggcctttcttcctctaccacagattgtaaaagttgtagtctgtgggacagaatatccccaaaacagttaatttgatttacataatagctctttttaacatagtaatttcaaaaataaaaataaagtttaacttgttgccagcacttaaaaatttggagattttacataaaatgattttttaaattctcctaaaagaaatcataataactttctatcctggacaatgcatttccagatgacaaagagggcttagctgaacaatagcagccttccagtgccctctccagttcgtcacaccatgccatttgctatcttctagccccagtagacacttgagtttaatatccttagctacccaaagatacatggattgatacagtgtggaggcttagctttgcttctaaatgtctgaacaaagaagtgtcagtggttgaatgggccatttagatgttcttattatatatccatcaactaagtaaaaataattttggctttgttttcaaagctctgtacttgaattcctgcatgtaatatttgaacagataatctctctgacctcttttttttacacatctgtaaaatggagactgtgatattcttcataggcttgggtcatgttaggttactttattaatgctagacaatttagtctaaactgcactcatagggaaaatagaagaagacagttacattcttctttttctggattggtacaaaaattttcatcttttgttagggtacattagcaatatgaagtactgatacatgcaacaactgggataaaccttgaaaatattataaataaaacaagcctgacaccaaaggtcatatattatatgattccatgttgatatggtttggctgtgtccccacccaaatctcatcttgtagttcccataatccccacctgtcgtgggagggagccggtgggaggtaaatgaatcaagggggcagtgatcctcatgctgttcgtgtaacagtgagtgagttctcatgagatctgatagtattagaagggtctttcccctcacttcactctcactattcttcctgctgccatgtgaagaaggactttgttggcttctccttccaccatgattttaagtttcctgaggcctccccagtcatgctgaagtgtgagtcaattaaacctctttcctttataaattactcagtctcaggtatgtctattttagcagcatgagaatggactaatatacatgtataagaaatacctagaataggcaaaactatagagacagaaagtagattaatagtttccagaaactaaggagagatgcaagcgggcagtgactgactgctacgatttctttttggaggtgatgaaaatgttttggaattagagagtagtgatggctgtaaagccttgtgaatacactaaaaaccactaaattgtgcagtgagtggtgaattttatggtatgtgaattacatctcaataaagtaataaggaaatatatgttttaggaagacaaaatttcatcttcagctgaggcaggagaatagggtctggaggcagggtaaacctaagggcaatttgcactgacttcctacaactgaatcaaaaggaaaaccccacctccccacaaccaattaacaaagggattagaggctactccctttgtactgcattgccgatgaaaaatggaaagtacctctgattggttctctcctgcaaccagtcacactggtcacgggccaagtcttcatgtgtaactttgtaacttcacttcagcctctaatttgccccctcctgcaaccaatcagacgtttgcatagggtgtaactttgtaacttcacttcagtctcttattggtcactctctgcaaccagtgagactggtcgcgggtcactccttcatttacatagtgtaactaagtaaccagtgggaaacctctagagggtaaaccccagaaaattctgtaaccagtgctcttgagccacttgctcaagattgctctcactatgtggagtacactttcatttcaataaacctgtgctttcattacttcattcttttgttgctttgtgtgttttgtcctattctttgttcaaaatgccaagaacctggacaactcatagtcaagaccctccactggcaacatagctatggtgacattctcagtcttttttgcattgctgaaaaggaatacttgaggctgggttatttacaaggaaagaggtttacttggctcatggttcttccagctgtacaagaagcatggcaccagcatctgtgtgtggtgacagcctcaggaaacttacaattatgacagagggcaaaggggcagcaggcatgccacaaggtcagagagggagcaagagagaggcgaatctcttttaaaaacaaacagctcttgcatgaactaatacagcaggaatttactcattacccaaggaatggcaccaagtcattcatgaacagtcttccccccatggcccaaacacctcgcactaggccccacctcccatctaggggtcagatttcgacacgacatttggagtggacaaacatccaaactatatcagtgatataacaaaataagcagattgtcattcaaatccacacacactgccttcctgagagtcctgtctgacctgactgccaaggccaaaggccaggtcaaattttttttttttttttagatggcatctagctctgttgcccaggctggagtgcagtggtgtgatctcggctcactgcaacctctacctccttcctgggttcaagcagttctcctgccccagcctcgtgaatagctgggattacaggcgtctgccaccgcacccagctaatttttgtatttttagtagagatggggtttcactatgttggccaggctactctcaaactcctgacctcatgatccacccgcttcagcctcccaaagtgctgggattacaagcgtgagccacggtgcctggcccaggaaaaaaatttaaacatcaggattcatggtttcatactgagattctgaatgatggggtcagacaggaatgaatttctattctaaatattttactgactacctctctcatatttctcaaaatgtaaaataagggtactgattagctcttttgttagcttaggaaaaataaatatcatgaacctactgtggttccagttaggaaatagaccctccataactgatacttttataattagtattatttggttgtaaatattaggctatcacattagatttttggcagttcaactgttccagggttggcttttctcttcctggcatcttagccagaaagaaaagaatgcctagaatttctgttagcacttaatgaatttaatcagcccccgagggacttttgatgtcagggaaatagttgacagagaaacatgatttttattctttctgtgtttctcttggtagttgacagagctttccctggcagaggtaacattacctgtgctgagagaggagtattaacatgctgtaagtgagatgttagaactaagagaacacatccctgtggccttacattaaaatgttccatgcatatgcttctgaatacaatttaagctgctgccaataagaaaataagccattgcctgaaaatgtgtgattcaattgtctatcatttttatgatttttttttaccctttcagacacattttagagattcttttttaaaaagtttgtttttggaaattgaaatgaaaattatcatctggaaatataagggataattgtgttattctgtgaagtattttataagctgtaatgttaagcagaaatttttaatcttaagtatggaaaaatatgtatatgaattgctccatttgatccaagtgatgttttatgcttttccttatggttaatggaaaggattatgctatgttgaatggccggaatatcaggagcatgggtgtcatttgttctcccaacaactatttttgggaagctaagtacatgccagaacatgtattaggaccaggtgatatggtgccaaataatatatgtatatcttctggaattttgagtttgctgtctaatagggggactgataacatacaagtagaaaaaatacatattgtgctaagtactgtaaaggaaaggaagagaatattatgatcgagaagcagagcttatagttccgcaccacaactaatttattgtgtgaccctctgataggctactgatgatgagtgggcaccgagcttctataaatttgacgaattaatcctttgaccattatggcgtgatcctctttttattcctgatgatgcttgttgacaaaatattacttcatttaaattaaatttgcctgagatttcctttctaatttgttttcaacctttatgtttagtttaggtgtatctcctttcagcagcgtgtagttggattttttcagtgtgaattttccccccttcttttttactaagggaattgaatttttttgcacttattttgattcctgaaatatttttaacattctttccatcaccttactttgtgtcaggatttttgtttctaaatgcttttccaccttcttctaaattaactggttttcttaattccattaatttcttattatttcggacgtttcactgttttcatttttagtgtgctctgccaaattttaaccttagcaaagtcaaatttaatgttcccaaataaaacctaaaattctttaactcaaattgtatcactcaaagttccaagttattttctatgcatattattttagctcaactttttcttcctcttagtaattattattatatttaatacattcaggttttaacttacatagattttcttatatactgaccagtttatttcttatcattgcttccagcatcccacttccttttgctcaaaagttcctattaaatttttagtagcttcttttaatggtaaactctctaatttttttgtatcactaaatatttttcttttgctgttatttttgaataatgttaagctaggattggaattcttagttaatggtattttcccctcaataccatgaagatattgttgtattgttttctatcctttattactacagataatgaaatctgctgttagtcaaattgatatgcttatgtatgtgatctgtctttttctttcctgctcacttttaagatatttcttacatttggagttctgcagtttcacaatgataagtccaagtatgcatttttgttgagtttttctcttacgctattctgttttccaacctcaggacacacttttttccagttgtagaaaattctcatttattatttatgtgaatattggtatttctaaaattacttttgttgtctcttttctgcattcttaaacatatttggaccatttatttctcctatccataactcctagctagcctttcacttttttctttatgtcttcattttgcattataagaaaattcctctggagtccttcagtttttaaatttgttgttcatcagtgtctattctgctacttaacttttgtatcatcaggatggctagttcatgctgcattattagcaaacagccccaagtgtcatggattaaaacaagaaaagtttatttctctctcatgcaacattctcaatgaaagttaacaggggagctctgtcttggtggaggcaccatctgggaatgtgaaggcaaaataaagaaaacctgtggaatcataaactggctcagaaagcttcctcccggaattgacacacgtcatttttcctcatattccactagcaaaagaagccaatggatgactccaaaggctataaggaaatacaatcttttttttttttttttttggagacataatctcgctgtcgcccagtctggagtgcagtggcaccatctcggctgactgcaacctccacctcccgagttcaagtgattctcctgcctcagcctccctagtaactgggattacaggtgcccatcatcacacccagctaatttttgtatttctagtagagacagggtttcaccatgttggccaggctggtctcaaactcctgacttcaggtgatccacccacctcggcctcccaaagtgctggaattacaagcgtgagccaccatgcctggccaggaaatacaatcttaatatgcacctggaaacaaaggagaactgtagtatttatgaaaagcactgcacggctactccaaatgttcatttttttttttaatttcaatttcttgttttaatttttagaagctctttttggtttatcttttttttaagtcatgttttcttgctttatcatggattcagttcctttttatttgtaattcctttacatactcttaatttctcctcatgttcattaatcttttattatttttattgtttatactgtatgtttcttttactgtgccaactgaattttttcatggtagtttttatttccacatatagttcgtaattttatagtttgagcccaccttagtgaactacttcctttctttgggaatgttgtgaactctgtgttgtgacagcattccccaagagtggttctgcttttgcttttattgagtctttaggatataaaaggtcacatatcagtttttgttaacttcttgcattttataagtagagtaaattagatcatatacttaacgcttggcccagccgtgaggtttttatttcttataggggtcatattgagtccaaagacaacagaattcctcacttcttgttcaggccatttgcatcatttttctaccttcttttcatggatttagggaatctgtgttttatatagggactttagatatatctccctgtgcttggaagactatgtctcctgtccctccttagacatcaaaaccctggctcaccagccctcaggcctatagcgagaaccaccctgtccctgaaccaccaccacattaactgaaacttattgcagagtcttcagttcctctgttcctttatcagaccttcagcattccatttcctttccttaaacttgatagatttttttaaattgttttacttatattttattcattatttttctgtgcctttaggtggtcattgatctatattagctgggttcattatgttttcaaaactggaagtttctaacatcagcttcctagcctataaaaaattattcaagttgcattatccacaatgctcttttaaccctatgactcatatcttaatatgaactaatacgaagaaaaacaagaattaataccaggtctcttgtcttctttccattttgatattaatcaattgtgtcatgttagacaagtcattaaactttcttgggctcaagcttccccatctataaaatcagcagttgaaactatatgccttagataaatgcattctcttctccaagctaagcaagtttaaatctgatgagcttttaggaaagatacaactttgtcctcagtactataatatttgattctttaattatttccagctgaagtcttttaaaatttacattattgcaataaatgttttacccgaactggtttggtaaatattttatatgcatctgtatataaagaaccatcatatcttattatacctagaaatgaatgcaattatgtttgccattttaagggtctcaagagttaatattaacaaagtgcttgttgacgtattttttttttcacatgaccttctgaagccagcctgcactactgccttttacataagtaaattagggtacatttttaaccttttcatgtttaaactaagacacatagtagctcttcaaaattgcaaaacagtctttagaacatttagtacacaataacccttctaattgcacgtgaaatgaaggactgtaaacttcataagtcacccagaagaacacaatgtaattccctttagagtatcctctttaaaagtggtctcagaatcagactccatgatttcagcaacacagtcaaagatgtactaacagatattacctaggttgccaatgaattgctgtcagttcatgttttatccatgaaaattttaaggaaaatgtaaaaatgatacatttgtttgaacttgtagagaaaattatgaaaaatccaagcttgtagggaatgatggactatctgcagaatattagcatagctctgattttgcaaacacgtggactcagataatcttacccagtggagacataccaatgcaaagtgaactaagatcttggagtactaatggacctatataacacattgagaatgttgaaacaacccgaaacaagctagagaaattggagaagcttaaacctgaggattggtgccctgaaatggaagagaaacaacagtcaactttatatgaacaggatgaaatagcatacaacaggatgatattaacatatctctgagcctgtgagggacagggaacagacttagagcaatccacccttgccgttaagatctattttgaagtgagacaggcgcttgtctcaaaggtcagggactaaatgtgtcttagagaagtcatcgtggttgttttaccttttcatccacctttgaaataaaagattagagataagatgaaatctaactagatccttgctaggagaatgaagttttaaaaggagagccatagtcacagctgtcttcagagtaggtagatgccaagtcttagggaagtacaggattaaccatgttggtaatgacagaacctaaggtatccccagcagtgttctttaagagtgtaaaaaacaaggattaggagagcaggtgattggacgcagctgctgaataatcttcttaacctcatctttactccacagggagaaaaataacaggaaaataaaagcttccaccaagtggttggtggcagtgaaacaaaaggagcatcaaaaagtacacaaggacagatttgtcctgatgctaataattctgaacaaaagggccaggaaattgctgtaaagtgctctgtactagtgtaagataaatacataattagtatacttaaataaagaaaaaaatagagtagaattctaggagtggttcttttttctaggcacttctaaagctgttattcactgagggcctaaataccttgtaatgtctcttcattaagtttttgttcatgaagtagcgagaaatgaatagctctcagtcaatatttaattgatgcttatacattgaatttaatcaggaactatctaaatgactcactaaccaacgaaaatttaagcaaggcaaatgtaacaaaggaaaatggggagcaaagcaggcaaatggtaccagattatgcatgagtaagaaatatgcatgagagaaaactttcatgtttgaagccatttgctacattcctggattactctagcacagcctaaataattctgattaatgcagcctcccaacgcatgatatagtctgcaatgaaaatggcccaaaatatataccttaatttctgtacaatgtactggttccttgttttagtgattctgtatttgtaaaagttcctatattgagtttgcttcaaccgtattgactgctgaagctcaagttctgtttatagcaaaggtcagggtctaaatatgtcttagagaagtcatagttatagttctccataattggagaactatatcgtacaacttctgccatgaatgtgagaccatctaatagtcaaactagaaagagtgaactcatagaacaccataagtaaaatgtaccccagataacatccagaccaaatctcattttatagtgcaggaaacttaggcgcagaaatgtttggttaaaagtggcacagattcacacaaaaccaaagtcttgatgttcagcatgcagaaggagagaacgtagttttccacaatttttttttcttcctcaaagatgggacaagggtgaccttactcgcattaaagaagtggatgatacttagttgtatttgaaagaaaaagagaacagagttctcatgctttgaaaacagaaagtaaatatgtatgatctcacttatccccctttatctgaggtagatacattccccgtggagtaggacagagcgtgatttcttcacgctactcggaatggtgtagaatttaaaacttatgaattctttatttctggaatttcccatttaatatttttggaatgtggttgactgcatcaacaaactccagaaagcaaaccatagataagaggggactactgtttatgaaatctaaaaaaactgaactcacagaagtagtaaaatgatggttactgaggttgggggttgagagggggagggaatgggggattgttggtcaaaaggtacaaagtttcatgtatagacaagaggaataggttttgagatctactgcatagcaaggtgactataatcaataataatgtatatttacctaagagtaaatttcaaatgtctcaccacaaaatagaggtgaggtgatagatatgttaattagctcagtttaatcatttttgatttttacatatatcaaaacatcacattttactcataagtgtatacaattatgatttatcaattcatactaataaaaacaaacaggtctggtgcggttgctcatgcctgtaatcccagcactttgggaggcccaggtgggtggatcatgaggtcaggagattgagaccatcctggctaacaccgtgaaacgccgttgagaggtgacaatgtgctagcagccctcgctcactgtgggcacctcctcaggccaaggcgtccactctggccgcacttgaggaacacttcagcctgccgctgcactgtgggagcccctctctgggctggccgaggccggaaccggctccctctgcttgtggggaggtgtggagggaaaggctcgggtgggaaccagggctgcgcagcgctcgcaggccagctggagttccgggtaggtgcaggctccacgggccccacactcagagtggcaggccggcacagccagcccctggcagcgagaggcttagcacctgggccaacgggcggaggggatgccaggttccccagcagtgccagcccgccagtgctgtgctcaaattctcaccgggcctctgctgcctccccttggtgcagggctcaggacctgcagcccgccaagcccgagctcccccacggtgggctccggcatggctggagcctctccgacaggtgccaccccctgctctgtggcacccagtcccatcaaccgcccaagggctgaggagtgcaggtgcacggtgcgggactggtgggcagcaggggatctactaggcgaagccagctgggctgctgagtttttgatggggacttggagaacttttatgtctagctggaggattgtatatgcaccagtcagcactctgtgtctagctgaaggtttgtaaatgcaccaatcagtgctctgtgtctagctaatctagtggagacttggagaacttttgtgtctagctaaaggattgtgaatgcaccaatcagcactctgtctagctcaaggtttgtaaacgtgccaatcagtgctctgtgtctagctaatctatggggactgggagaacttttatgtctagccggaggattgtatatgtaccaatcagcactgtgtctagctcgggttttgtggatgcaccaatcagcactgtgtatctaggatatctggtggggactgggagaacttttatgtctagctagaggactgtaaatgcaccaatcagcactctgtgtctagctcagggattgtaaacacaccaatcagcaccctatcaaaacagaccaatcaactctctataaaatggaccaatcatcaggatgtgggtggggtcagataagggaataaaagcaggctgcccgatccctgcagtggcaaccgggtctggtccccttccacattgtggaagctttgttcttttgctctttgcaataaatcttgccgctgctcactctttgggtctgcactgcccttaagagctatgtccttaagagctgtaacagtcaccgggaaggtctgcagtttcactcctgaggccagcgagaccacgaacccaccgggaggaatgagcaactctggacgggaggaatgaacaactccggacacaccatcttttaagaactgtaacactcaccgtgagggtctgcagcttcattcttgaagtcagcgagaccaagaacccaccaattctggacacaccgtctctactaaaaacacaaaaacaaaattagccgggtgtggtggcgggcgcctgtggtcccagctactcgggaggctgaggcaggagaatggcgggaacccgggaggcggagcttgcagtgagccaagatggcgccaccgcactccagcctgggcgacagagcgagactccgtctcaaaaaaaacaaaaacaaaacaaacaaacaaaaaaaacataaaggagtcctcacttgatgacaatgatgacagcttatatatttagagcacatatgaaatactaggtactttcctaatccttataaacacattttcttatgacgtaacctaaagtaggttccaacatctcataacatctcttcatcttgttgattaaaaacacgtaagttcagagtggttacataagcttcccaatatctcagtgtaaatctgtagcagagatgggattcccattcagttctatcttgactccagggtcagaattcataatcacttccatattgctacagttgaataagaactgtattttgggctgggcatggtggctcatgcctgtaatcccagcactttgggaggccgaggcaggcggatcacctgaggtcaggagttcaataccaggctggccaatgtggcgaaaccccatctctactaaaagtggaaaaattagccaggtgtggtggcaggtgcctgtaatcccagctactcaggaggctgaggcaggagaatcacttgaacccgggaggcggaggttaccgtgagcccagatcgcaccactgcactgcagcctgggtggcaagagcgagactccatcagaaaagaaaaacctgaatattttgaaccttaagtgaaaggagttacataagtaggcttcaagaaatgcacccaccagagtgataccagagcaactatttgcagtgaagtactaatagggactttgtgtatgagagtctgatattagcagcaggcagttgtgctgtagtgctttcagctggtattgcagaaaaaaaaaatcacacttggctgtaagtaagctgttgattgcttacacgggtttctgtggcatgccagctctccctgccacctactcttccttatcaaacagccaggagttctaagtgaggtgagaatcccacttgacaagcaggcataaaccatttgaggaaaatacaaattaaaaggctccaagacagaaataggagcattagcagcaggaagtgtcttggggatacattgtgtcagattacatccaggagttgggagaataagtgagtcatagcctcccagtggataagccctgttgtgtcagtagctgggcagcctcagaagctgtattagctatttaaagttgccagaactgctgtgaatgcccccaagctagcatctgcttagtaacatccttgaattatgcgcagtatgcctatttctcaagtagcttcagcatttctcctaacttctgacctgtgtcaaagcatagtgatagaattttgttcgtgtttaaggacagtaatacagaatagtaaagaactagagatattttgctcaagatcacctagcgagtcaatcaatgagctaaaattacaatgttgatctcaaggaacttttggtctgtgtaaaaatatggagcataaatataatgtcattgcacacatttgatcaatgtcttggccaagaaatctcagttgtcagaaacagaaaccctcttaatttagtccaaacaagaatttagtttacctgaaggatacagggaatctcatagaacttacagctacgaagtacagctttgttcaggtcaggagcaaaggttacctttctgtatttctgggacctatttcagggaccctgtggcacttagcattctctcttcttccccaatcccctcctgcgccctcctccaacccctgaaggtattttctttcatctttgcagtttcttctttctaccttagtatgtattcagtcgatactggccatcctagctctagactaacatgacccactggattgggtctctgtatcctaaccagagattccacagtgagaaaaatctcctgctccaaacagtttttagtacaaggaaaaaccaggacctcctaagataaagagttgcattcttggcagagaacccaaagatttttaaaatacattcagaaaattgccatcaatgctcaattgtaatctaattcaaattgtagcaggggcagggtttatccctggttagtatataacaacaccgggaagccacttccttcctgccttccagacctcccctcagttgttgcctgggtgctttttaccttgattggctcagtgtttcctgactgctaatcttgtatcaaagagaatccaatacaggtattggtgtttccacttcctgttgcttacgtcatttctagctattggtggggagaacagttgttactggaaaggggtcccaatcaagaccctaagagagagttcttggatctcacataagaatgaattcgagaagagtccataaagtgaaagcaattttattaagaaagtaaaggaataagagaatggctactccataggcagagcagtggcatgtgtagctgggttcccatttttatggttatttcttgattatattttaaacaaggggtggattattcatgagttttccagtaaagggatgggcaattcctggaactgagagttcctcccctttttagaccgtatagggtaacttcctgatgccatggcatctgtaaactgtcatggcgctggtgggagtgtcttttagtatgttaatggtttataattagcgtataatgagcagtgaggacaaccagaggtcactctcttcactatcttggttttggtggatttcagccagcttctttacttcaacctgttttatcagcaaagtctttctgacctgtatcttatgccaacctcctatctcatcctgtgactaagaatgcccaacctcctgggaatgcagcccagtagatcttagccttattttacccagcccctattcaagatggagttgctcttgttcaaacacctctgacacagttgctgtcttttttcagctctggtcaggaacttattacaggcaaagtgctttacagcttaaaaaaggagggataagggaatagatgctgtctttggctttggccttctttggaatatctagcttcttaactaagaataaatttttataagagacatttagatactgttaaagactagcactagacatttttactagaaattccaggattgtcaacacaataagatttatgcagattagatggtatggtgttgtttattattacaacttgataactagaccagtacttctcaaacttaaaagcgcttacagaccacttaggaatcctgttacaaatgcagattctgccctaggaagcctgtatggtacctgagattttgcatttctaaccaagacctaggtgatcctgatgctggtgacccacaaaccgtacttaagtagcaatgacgttaagatactgttttcatatccagaatcactgtacttttcagaatagaaattaatagtctaccttcttatttcagacctgaacaaaatgaacttcagtttaggtgggttacttgcttaaggacaatatagtttgtaacagtgttggaattaaaagctagattctggtgattctgttataccaacttaagggactaatatttattatgtcgattccatgctgttttgttcactttactgaaaatcactgcatacgtagccttaattcactatcgctgtctagttttcagctctagtaggtattgtaaacataaacatacacagaaacagatttatctattttccagccaagcttttgcaaagcaaaatccaggctgcagagagattgttgattgatactaaaattttgacagctgagagtatattttcagcaacaagatgagtaacttgggctaaaggagactgatgagaataaaacttagatttattaaggacctttccagtgagcagtctgtgtcatttctcaatgcaaaaataagtagtgtccaattccaattatatgatcctgcaacacgtaatttagctttgattaattgctataaattgctatcatcttcttaatcctgtatgtatttggtatcaggctttaatgcctgtaaatttaaatactggggtactcaatgaatttccaaaataatactctacagaatacatcctatttcatttagaagtttttaaaataactccagctactgtcttttatgtaatatgtgaattctacacttatcgtttcgttttataaaccgtatgtagcagcatcagtggattgggaacacctgtgtaccccatgtgacattttacttagtgtggacgaggggaagtcaactgcagcaaaatcatttcttttgatttctaacaatttcttctagccttatctgtaggatacttgacaaaaaaaggatacaatatttctatctatttaagatgtatatcacagtccacttaacagtttgaggaatgttttggtagtttctgtgaccttgagtaagctttccatttcgagcctccgtttttgcaactacaacatgcagacagtaacacctacctcgcaggataatatggatgaaatgacagcatatttaaaagcacttaaccagtgcttggcataggaagcactcagcaaatattcttttcttatttcctgaagcatttaatatatttaggattaagcgatagcaaaatgataattctctttacttacctctggcatctagaatgctcttggtgactggaataagttttaattgtaatcaaaactgaacgattaatagtgtaaacttgctgagggagaaataaggaggacatgctttccagaaccaattaaaaatgattttagatgatctgctatttcatattccccacaccattgcttttcctattagcaggtataagtgagaattaatggcaaataatggcaacacaaatcagtactaaagtgcatagtcatttttcatcatgcagctaaaacggtattattaatgtcaatttattggttatatataatgaactactatgctggagttttgtagaaattattttttattccaatatagttacttgatcaaggagactaagttccttttataaaataccagaggatgtcatgaatgaagaaatatggctagtccggtgcaggctgtgtatgcaggagaatgaggttttctctctcacaattacgtgagcctctgcagagtgtactttttcctggcctccagttgtggttaggtgctactggtagatttataaatatgtcatagttatatcaaatattttaatcattctgagccttttcgcctcatccaagtaaaacaattgtcttctccaaatgaagtattgtaaatatttatttgcagattttaatcaacctgtgacagccctctcatatgataaaatggtaactttgtaagattcgatgccccaaagatacatctgcaccatttaattagctggatgtgagtctacagtagagtcaacttagtttttacagatgggcttattttctgattggagagaaccgcatacagctatgtaattattacaacgtataatgtacaacatacattatatatatagtgtataatactccagtgttcacttaggagttcctatctggaattggtcttgtatctgttataaacaattgtagtttctgatagaagttacataaacatggagggatttttattggtatgatttcaaacaaatcattttctaccttaagactgagtcaaatccaaactagcatgtgcttaactgaaatcatgtatatatgattttgttttgttttgtttttgagacagaatctcgctctgtcgcccaggctggagtgcagtggcaggatctaggctcactgcaagccccgcctcccgaattcacgccattctcctgactcagcctccagagtagttgggactacaggcgcccaccaccacgccctgctaattttttgtatttttagtagagacagggtttcatcgtcttagccaggaaggtctctatctcctgacctcgtgatccacccgcctcggcctcccaaagtgctgggattagggtcgagagccacggcacctggccgtatatatgattgtttattcactaattccttcacttgctgaacagatattttggagtttctaccaaattctaagtattgtgcagtatactgttaagcacaaccttgtttcaaaggaagtagtagtcaaagcagagtgaaaaccagatgaacagattattcgtcttaatctacagacttagaaggaaaaaactaccaggcattatctgccagatcttctcataagcactttcacatattttctgtcatatgaacagattatgactatttattgtgattagacctgtgttattttgaagcatgaagtaaatggaaaatgtcacaggagaggtgacattggaacaggatggtaaagagtaggagattgcaagagaaatctattctgtttgagaacttctaaacagaaggtcagtttgagcataaattaatgattaatttttattcccttatttttagcagtaaaaaaaaatattttactgttcagtttaaaaatgtttctggaatccttagggttttccttttgctccccccaccccttaaacaattctatttcatctttcagtgaactggaaatactgaaaaaatataattttgtccgtatttcagtcttctataatatgtttgcccaatgaaatatgaacacaatattgcataatactgaaaactggctgtattagtccattttcatgctgctataaagaacttcccgagactgggtaatttataaaggaaagaggcttaattaactcacagttcaacatggctggggaggcctcaggaaacttaaaatcatgcaggtaggctaaggggaagcaaggaaccttcttcacagggaagcaggaaggagaattcccaagtaaagggggaagagccccttataaaaccattagatctcgtgagaactctctcactatccggagaacagcatggggaaaaccacccccatgattcagctaccttcacctggtctctcccatgacacatggggattatggggattacaattcaagatgagatttaggtggggacacaaatccttaccatatcactgggatttaaaaaatttgtaaatgctcatcatttacctgtctgaaagagtggtgtggggttcaggatttcctctagcgtaatgagtcagaatactgattgttataaatgttcactgtggctcttttgtgggtattgcacaatgtattgttgcttttcttaagcagttcataaagtaagtaaggaagtgacttgtatcatggtcatgatataaattgtattagacaatacatgatgagatgctcaattcttaaaggaggagagattcttctttaatcttaatagcattttctctgtatctccttcctagaacataagttaacgtgtgtacctgtattaacctcacccaccttggtttgcaactcactgagcacaaggaatatttgtattaatacagttgttctaactcagtgcttttcaaccaggggcaattttgtccctcaggagatacttggtagtgtctggagacatttttagttgtcaacactggaggataggtgctattttgtaaccagtgggtagctgccaggtatcctgctaagcatcccacaatgcagaagatggcctgtacaagaaagaatcatctggccaaagatgtcaagtgtcaaggttgagaaaccctgctctgtactataccctggggtcattctgtgactttggcattgttagctcatacattcagcccacactaaaaaggagaaattgatcacctaatgtgtttatccaactgtattggaataagagctgagttattaggctggaaattacatgttctgctgctataaaaaaattttacttttataaaataaaaatattttctacctaaaaaagctgaagaaataacttctcttgtactattgtgtggccgtagcattagtgacttcattcagtgtgtagacattgagcagtgagcttattgataggccctgcgaatctgtgagggagcaggatagacacattgttctcattagctctctaattccacaggatctgagacagatgtgaaacaaataattacttaaatacatattaaaattttaatatagatacatgatttatggtcagcagaaacacagaaactatagaaagacctgagttggaggggtctaggaaaagttccatttaagtagaaaaaaggaggtgtaagagttgaccaggttgattaagcattccagggagtgggaccagcataggcatgaacttggtgcattcaaaaaactgtaaggaaccaagtatgactaagtgcagcagttaaggagagtggcttgagcatgaggcagggcccagatctatcaggggtccctatattccatgtaaaggatttctaactttattctaacaacaagagaaggagtttatcccagctctggcaagatggtggtggccgtggtgctggcagctgggttgtgccctctgcagagccatggcggccccagggctgcgcggcacacatctgaggagctgtaggtgtgactggtgggaatgaaatgaccaaggcccagcgggcaattcctgggggtgtagccccaaccatcttctgtgggatcctggaccatcgcctcccagcctacatcctatatgaggactagcagtgtcttgtgttccctgaggtggctccataggctcctgtgcactttctggtcattcctaagaagcccattcctcggattaaccaggctgaagaagaagacagcagcttcttggacacctactccttgtgtgtaagaagatagcaagggctgagggcctaggagatggataccaacttgagatcaatgatgagaagctgggtgaacaatccgtaaatgacctgcacattcacttacttgggagctgacagctccagtggcctccagctttaacctctgaactgaccaaggaccctagacctgggtgcttggatgggaaagagaaaaagggaagctgtgatgttaataaaactgctctctcccaaaaaacaatcaatcagtcaatacatacataaataatgaaaacaggggaagacttttagggagaacaactattataagattctcacataaagcctaaataaagcaattgaagaacattacagactgttttttttcctttttctttatattttcttatttttcatgtatctgctgagacaatgttccaggtttctacaggaggatcttatgatccattaattggattgaattattgtaggtatctatatctgaaccagtcaaagcctggctgattctcttatgtggtaaaatgtcaaagtatcttcatactgcacctctccattagtaagccatgtttttagcaccttgtggtaaaatatttttcagtgttactaaagaaaataaactagtatttttcaaatgtctcctatgtaatgggagggaagtaacattcattggttgtttaccaagtgctaggactaggctaagcctgtcacctctcttcttcctctaaagcaggtgttttgtttttcataaagattagaaaaccaggtctcagaagttctaaaatgccctagtaggttaagactacaattagtaattggtaaacatgctgttagaactaatctttctgactcccaagactgcaacttttctctctgcaacatggaggagctaggtcatttatatgtctcatttttaagctatataacaaccatgtgaggtagacattattattcacatattttatatgtgtagaatctctatctagggtgtctcagttagtaattcctgggagctgcagtttagatccagatttacctgactctggaaactcttttcttttcactgcactctgatactgtctacaaaaattaccaaagtctaacatctttcctccttttatagactttcacgaagatagagaataactggtcagcatcctcttcaaagtggctttctgtataatttaaagtaatcttcaaggtggtattgatagcaagcttcataaagcatggactgtagtaattctgccaaagactgaaacaataaatagtaaggtaacatataatctatagctttaatgtaggtgatttcctacaaatagaaaataaataatgcctattgcatatttccagttatatgatctcttcttaacaatcattggagaatagaatatttataacagactaggcaactttatgtttcacccatctgagagctagagctttgcctggatatagtgctataatatttcaatatgactccttaaccttgtctagttgggggcttggtttgggggtgggcaacgtggtatatttcaattaaattaactttggaaatcatacagtgctagatttgaactctactgctgaaaccagctggcagtacaactttaaccctctgattcgctgagacattttttattaaatggaaataatatttatctcagagttgttgtctcgatatttataaggtgcctagcagagtattagatagaaattcattaaattggaaagttccaacatagtcatcatcatagttgctgcccttgctgtttttattctattttgttgttaatctttctatttccaaggacccctaagggttggcacagcagggagaaaggggtcctactggaatctttggaagtgttgacaatagaatttcctttaaaaaacctctcaaatgttagctgaggttagatcatttcaaaagaaccttctggcatttgttgacaatagagccattctagatctcttttaatctagttgagtccccggagaacagttaaatagttatagtgcaggccttgcgcatgaagcaaataaagtcaatggatactttattgcactgagttgggaaattacaagtaaaaggaaaaaaattatatcaaatgtggcccaatgaatctagtttcctggtaattgaaagcacttgttagtgattccaacaaagttaagggaaaacattctattgttaaaaagagacacctctctatggtgaatctaggccattgccatgacaatatcaagtcttgtcatttctttattttactttttgttctctctgaaatatgctgttttcatagtccacaagataatattaataatagtgcgatttggctttgtattggagacatttttcaaagcatttatttatccgttggggataaggaagttacaatacaatacttgatatttcgtgtgtatttcacctggtaacttaagtacgtttctaaattttcaattttggaaactcctatggttgttctttggtttaattttttttttatgatgacagaaaagactgtaatgtgatttgaagcccttgtaacgagtacaggtaataatgtatccaggatctcttttcttctcctcaatgccaagttaccttacttggttcagcctgacagtttctttcatctgcactccctgcgtagttcctacgtttaacctgcctgaaacacagctcctcttggtccctcatgtgggcaaaagtcagccccattctctggagtaatgagtttgatcttgacattcagcatgcttcatgatttgtcctcaacttgactttctaatttctgaatgaacatgtttcccattactttccaggcccagtcaaattaatcttaatgatgttgaattacattgaacacaaatttatcttttcaaactctgttctacacagttaataataaaggaacaaggaattgggggaaatgcaaagagagaaaaagtgggagaaagagacaatagaatgtacatatatttctatcttacgttctgctggtgatgcttcttgccaaagtgaggctgagatgagatgtgagattcccttctccaagttgccatctgcctcttttgtgtgaatatcttgcaattctcagtgtgattcttgagtttaaataaaaaaatatatatataccatgttgtccctaaatacaggtcaaaagtcatccacatatagtgctgagtttaaaaacagtgacctatttcaatgctaggaaaaaacaaaacgtaaacacaaaacacagaagtctgtctatgttgggtttgatgaaaagagggtaaaatgttttatttttgttttcggttctgcctcaaatacggttttcctagtctacaaaattatattaacagtggagcaatttaactttgcattgtagacatttttcaaagcatttatttatcctttgggggtgaggaagttacaatacaatattttatccatacccaacatggcaactccataatgaatttgggtaattttattacatgatattttcagcttgttctttgaaccttagctctcaattatactactttctctactggcagcctatcaatgtttggaaagcctcttcatttcttggttatttcagtttccaaaaagtgaatttatacaggtagaaaaaagtacattttcacgttttaattaactgagaatccaggaaactaaattcatcaaataatgttgtcaatttcatataagtaaagtctttttataagtcatccacaaaattttaaacatcaggacctaaattctgggattctgattaaaaacttatgcccatttcattcatgataatacttttctaattacaattttcctctttgttaaaaaataaggctggacgcagtggctcacacctgtaatcccagcactttgggaggccgaggtgggcggatcatgaggtcaggagatcgagaccatcctggctaacatggtgaaaccctgtctccactaaaaatacaaaaaattagccaggcatggtggcgggcgcctgtagtcccagctactcgggaaactgaggcaggagaatcacttgaacccgggaggcggagcttgcagtgagccgagattgcaccactgcgctccagcctgggtgacaaagcgagactctgtctcaaaaaaaaaaaaataataatagtaataataataataaataaataaataaaagggagtggaaaaaaatctaccaaaccttggattcaaagtccatttctttcagagattttattgtaagcattatcttattgactatgttcacataacttttaagagctaaaagaataccacgtttaatatgttgcactctaacaattttaactaaaaatattcatgcttagttacagtgtgtagaaacccaaaatattaaggatatatgtactttgtgggatgatcctctgatttaatatatgtggtctcttgaatctccctatattgaaccttcattttctaatatttattgtgcagttctctctctgtggtgtgtgtatgtgtgtgtatgagtacagaaatggtatataataaaaagcagtttctagcataaacaacaaaatgaataaactacacaaaattacagaaaaaacactaatctacagaagaaaaaaatgctggacctctaaaagtgaactatttattattcttgagaaaagcttatcaaatgagacttgcaatatatataagttgcttttccagattttattttaaaaatacaaaggcaaattactagtgctgtatttgtaagattaaactgcccactccccaatcagatttttggattatttacatgaaacgaaaaacacaaaccacccttgaaaatacgaaaatcttaattatagttacggtgtacagtggataagtgaagttagaatatctttctactgatggaaaaatgtcacttggctttgagatgagtcttttttttatttttattttttgagacagagttttgctcttgttgcccaggctagagtgcaatggcacaatctcagctcactgcaacctcctcctcctggattcaaggtacataccaccacacccggctaatttttgtaattttagtagagacaggggtttcaccatgttgaccaggctggtctcgaactcctgacctcaggcaatccacctgcctgggcctcccaaagtgctgggattacaggcgtgagccattgcacctagcatctttttaacacagggagagaatccattgaaacttttttttctctgtaacccctaacaacgttcggactatttcagcctttaaccatttggccctactgagtgtcattagattggcctcaggatccgtaagtactattatttttctcttgagcttacctctacatttatttaagcatgaaccttctcagtggttcactatagctttacaattcagcactttatccaaatacagctagaaaacttctttttttttttttttttttttgaggtggagtgtcgctctgtcgcccaggctggagtgcagtggcgcgatctcggctcactgcaagctctgcctcctgggttcatgccattctcctgcctcagcctcccgagtagctgggactacagggcccgccaccacgcccagctaatttttttgtatttttaatagagacggggtttcaccatgttagccaggatggtctcgatctcctgacctcatgatccgcccgcctcggcctcccaaagtgctgggattacaggcgtgagccacagagcctggcctctttttttgttttaacctctcatttcgaggcttctgtttgatctgtgttttagttagtctgagtttatatgtggctgtgtctagccatttacgtaggtcaattggactcaaaacccatctttcacttgaacctgcctttctttacctatcctatgtgcaagttctcttgctatttattttgacaccccacaaatttatcgaggttaatagactactaattccaaagcatttctaaatcagattgagtctattctctcagatctgtgaatacctattagggatggtatttgagataaaaatatgaataaaccgtacccttcacattttcttaaataataaaaaaaaactgaacagaagtgcaagactataaaatctctgactgcattaggagatcattattgcagtgttcaagtgtatggttatgactacaaagcaagaaaataagttttcttctctggttaacttacagccacatctcaagcattataaagaagtgaagagggaaatgataacgtaaaattggatggtgaattaaactttcattgtgtgttgagctcatcctaagactaaagcacagaaacatgtccataaaaattgtgattgtttttttgagatggagtctcactctgttgcccaggttggagtgcagtggcaagatctcggctccctgcaacctccgcctcccaggttcaagtgattctcctgcctcagctcccgagtagctgggattacaggcacctgccaccatgcccggctatttttttctatttttagtagagacacagtttaaccatgttggccaggctggtctcgaactcctgacctcgtgatctgctcacctcaacctcccaaagtgctgggattacaggcgtgagccaccacacctggccccaaaattgtgatttttattggttataagacctaggcattgtccctgtttttgagttttggaaagctaacattttaaactcctgttcacaaaacaggtgagagtaggactttcccctctcactgtgctaatcatattactatcgttggtcttgtatcaatttttaaaacatcatagccattattattttgcagtctgtattatttcttctaagtattaaatgacagatattgatatgaagagcaagaggctctccaaggaagcctcatctgtacaaagattagcaagaggttgcagcaattatgaaagttgccagaaatcacaaatgttcctaattttagggagaataggatgccccccatcacacataatggctttatcatcaggatttgagcccatgcagcagaatatccaggttctcttagaaaccagatgcttccttcctcctgcttggaaattggaaatatatttacatcttcaagaatgcgcgaggttcttctctgaagcagagccctgcattgcatctaattgtagaaattacaaaacttgtcagaaagttaaaaaaaataaaagaaatagtaacagttgcattgatttagaaccagctgcctttcttttatccaccctgatagagtagtgctttaattatttctcctaactaaaatgatacttccctcttgagaatgtctgggcctgtttatactgtcaccatcgttttgatacacaattgtccatattgatactctgtttttaccattaattttccaaagagcctctgaactcattgatagtgccggaacacagccttgccaacacagtgcccagccctggtaaactgagtcccgacaccacttttagttccaaaatttggggaaaaaatattattttgctttcacattctctctgctctctttaatacacacaactgaattcacagcctgaggccagcagagagcttagttatccacatctaaaggccccatgtcacaaaatttatctctgatatttaatatctttgaaagcacttaatacaagcccagtgttagctattctgtagtatgcctgaatccattaaaatgaaaaaaacctcagtaatgatattatgttgaagagaaatgttttataactgtcatactttggttttcctgaaatcataaaatggtcatgaaaatgatttacaaaaaaactgggttagagtgtaccagagtaccatagtcaagtataatgacatccaaaagaatgaaatgagcatggatagaggagggagaggtgacagagtaatgaattgccccctactgattttgttcctgtttgatctgacaacattggaatgacagctgctgaatgagacaatttgattcaaatgatttgcatatttttcaccagaaaaagtggtttgtagtttatggaatgagtcccttattctaaatatggtgctaatttcaagtacaggtatcctctgatattttgtgtaagtgaatgtgttacttattgttaaccagtattgatgaatttttattatagatccaaaaaatgatataattttagagatttatcccaatttctatcaaccagaaggtgaatatataccagttttccaaattacatggtgcatccccccacctccctcttttggtggaagattaggcatgcagtttttaagacccaatcaatctattgatagtgttaagtttcactatcctccacctgaaaagcgtgatttaaaagcaccaaactaagtatagcaaagttcttgcattgcttggcaatttcataatttcaggtttatatcgagtgagaattacaatgtgaaggtctttacttgttttgggctataatttgagatggaagtgggagaatgtgtagaatggttgctgatcatatatcccagatgctgcatttgtgggagaatggattgatacccagaggttccttctaacatagttcatcaagccagccagaaatttaagttaaccttgatatcccctgaggttaggttcccactgcacttggagtaaagactagcattctttttgtggctcatacatgccactgtgccattcaactctttcttttgtagcacttattcaaggtacttactgcctttttaaagtttgctcatctgtcacctttcaatacaatttacctttaacaccctatttaaaattacaaaccccaaccccaatgctctggctaacttttgcccttcactttttccttttttcctctagcatttatccttgcatctgtctgtctcagcatcttggaatatgatctcaaagagcacccgattttgtccgtatcgttcaaagatgtaactcaaatgtttataatagtgctttgtacatagtaggttctcagtataacatttgttgaatgagtggttgtttttgtatttcttttattatttaatttttgttcctccgctagattcgtgttcaggattatatccccagtgcctttcacttatttttcatgtaacatatatttttgaatgaatgaatgaatcaagaaaaaggttctggaataattttaatatttacctgtctgttaaaatattctcactagacctgttagaaactcaaagctaaattgaagctgatgtgatttctattcactaatttcctctggcaggcagtgattgggaaacatggtaaataatcagcgcatgtagttgtgctgtttaaaatacagcagttggccaagttctgtaagtatacaaatatattttcagtagatgagttaaaaccagcatctgattactttgtgctgtttggcttaaatagaaacaatttcatctcatttaaataaacaatcatcatatttttcatataaatgatgatataagctctggtaataagggcttatgttattgcttagaataggaaagttgcataaatgtgatcactctcaaaataatcttttgttacatcctggggagggggtaatgacaagcacttgcagtagctctatttatttatttattcatttttattgaggacatatgcttcagaggcttaaaacttaaaagattgaagcagtattataaaggagacataaatggcttttaatgcttgctgaaagcagataaacttaaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga

SEQ ID NO: 1600 - DNA, 165748 bp, Homo sapiens
cgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga
